(12) United States Patent
Desjarlais et al.

(10) Patent No.: US 10,738,132 B2
(45) Date of Patent: *Aug. 11, 2020

(54) HETERODIMERIC PROTEINS

(71) Applicant: Xencor, Inc., Monrovia, CA (US)

(72) Inventors: John R. Desjarlais, Pasadena, CA (US); Gregory L. Moore, Monrovia, CA (US); Rumana Rashid, Arcadia, CA (US); Matthew J. Bernett, Monrovia, CA (US)

(73) Assignee: Xencor, Inc., Monrovia, CA (US)

( * ) Notice: Subject to any disclaimer, the term of this patent is extended or adjusted under 35 U.S.C. 154(b) by 442 days.

This patent is subject to a terminal disclaimer.

(21) Appl. No.: 14/155,334

(22) Filed: Jan. 14, 2014

(65) Prior Publication Data
US 2014/0370013 A1 Dec. 18, 2014

Related U.S. Application Data

(60) Provisional application No. 61/752,348, filed on Jan. 14, 2013, provisional application No. 61/764,954, filed on Feb. 14, 2013, provisional application No. 61/780,334, filed on Mar. 13, 2013, provisional application No. 61/818,410, filed on May 1, 2013, provisional application No. 61/778,157, filed on Mar. 12, 2013, provisional application No. 61/913,832, filed on Dec. 9, 2013, provisional application No. 61/818,153, filed on May 1, 2013, provisional application No. 61/913,870, filed on Dec. 9, 2013.

(51) Int. Cl.
*C07K 16/00* (2006.01)
*C07K 16/46* (2006.01)
*C07K 16/28* (2006.01)

(52) U.S. Cl.
CPC ........ *C07K 16/468* (2013.01); *C07K 16/2803* (2013.01); *C07K 16/2809* (2013.01); *C07K 16/2896* (2013.01); *C07K 2317/31* (2013.01); *C07K 2317/51* (2013.01); *C07K 2317/515* (2013.01); *C07K 2317/52* (2013.01); *C07K 2317/528* (2013.01); *C07K 2317/55* (2013.01); *C07K 2317/565* (2013.01); *C07K 2317/622* (2013.01); *C07K 2317/64* (2013.01); *C07K 2317/94* (2013.01)

(58) Field of Classification Search
CPC ...................................... C07K 16/00
USPC ...................................... 424/135.1
See application file for complete search history.

(56) References Cited

U.S. PATENT DOCUMENTS

| | | |
|---|---|---|
| 3,773,919 A | 11/1973 | Boswell et al. |
| 4,169,888 A | 11/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,364,935 A | 2/1982 | Kung et al. |
| 4,322,348 A | 3/1982 | Asai et al. |
| 4,331,598 A | 5/1982 | Hasegawa et al. |
| 4,361,650 A | 5/1982 | Hasegawa et al. |
| 4,362,663 A | 12/1982 | Kida et al. |
| 4,364,866 A | 12/1982 | Asai et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |

(Continued)

FOREIGN PATENT DOCUMENTS

| | | |
|---|---|---|
| EP | 0 425 235 B1 | 9/1996 |
| EP | 1752471 | 2/2007 |

(Continued)

OTHER PUBLICATIONS

Whitlow et al (Protein Eng, 1993, 6(8): Abstract).*

(Continued)

*Primary Examiner* — Sean E Aeder
(74) *Attorney, Agent, or Firm* — Louis T. Nguyen; Robin M. Silva; Morgan, Lewis & Bockius, LLP

(57) ABSTRACT

The invention provides novel heterodimeric proteins including heterodimeric antibodies.

15 Claims, 109 Drawing Sheets

Specification includes a Sequence Listing.

(56) References Cited

U.S. PATENT DOCUMENTS

| | | |
|---|---|---|
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 4/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0015108 A1 | 8/2003 | Presta |
| 2003/0223999 A1 | 12/2003 | Lindhofer |
| 2004/0071696 A1 | 4/2004 | Adams et al. |
| 2004/0162411 A1 | 8/2004 | Lanzavecchia |
| 2004/0170626 A1 | 9/2004 | Schuurman et al. |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Chamberlain et al. |
| 2009/0214539 A1 | 8/2009 | Grosmaire et al. |
| 2009/0252683 A1 | 10/2009 | Kischel et al. |
| 2009/0252729 A1* | 10/2009 | Farrington ....... A61K 47/48338 424/135.1 |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |

(56) References Cited

U.S. PATENT DOCUMENTS

| | | |
|---|---|---|
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0336981 A1 | 12/2013 | de Kruif et al. |
| 2014/0024111 A1 | 1/2014 | Kannan et al. |
| 2014/0072581 A2 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |

FOREIGN PATENT DOCUMENTS

| | | |
|---|---|---|
| EP | 1829895 | 5/2007 |
| EP | 2009101 | 10/2007 |
| EP | 2 006 381 | 12/2008 |
| EP | 2 009 101 A1 | 12/2008 |
| EP | 2 194 066 | 6/2010 |
| EP | 2 202 245 A1 | 6/2010 |
| EP | 2194066 | 9/2010 |
| EP | 2522724 | 6/2011 |
| EP | 2 155 788 | 2/2014 |
| WO | WO 87/05330 | 9/1987 |
| WO | WO 92/11018 | 7/1992 |
| WO | WO 93/21232 | 10/1993 |
| WO | WO 94/13804 | 5/1994 |
| WO | WO 95/20045 | 1/1995 |
| WO | WO 96/40210 | 6/1996 |
| WO | WO1996027011 | 9/1996 |
| WO | WO 1998/050431 | 11/1998 |
| WO | WO 1999/37791 | 7/1999 |
| WO | WO1999054440 | 10/1999 |
| WO | WO 1999/066951 | 12/1999 |
| WO | WO 00/61739 A1 | 10/2000 |
| WO | WO2011005621 | 1/2001 |
| WO | WO 01/24763 A2 | 4/2001 |
| WO | WO 01/29246 A1 | 4/2001 |
| WO | WO 01/62931 A1 | 8/2001 |
| WO | WO 01/88138 | 11/2001 |
| WO | WO2001083525 | 11/2001 |
| WO | WO2001090192 | 11/2001 |
| WO | WO 02/16368 | 2/2002 |
| WO | WO 02/30954 A1 | 4/2002 |
| WO | WO 02/31140 A1 | 4/2002 |
| WO | WO 02/088172 A2 | 7/2002 |
| WO | WO2002062850 | 8/2002 |
| WO | WO 02/083180 | 10/2002 |
| WO | WO 02/098883 | 12/2002 |
| WO | WO 04/010957 | 2/2004 |
| WO | WO 04/043493 | 5/2004 |
| WO | WO 04/103272 | 12/2004 |
| WO | WO2004106383 | 12/2004 |
| WO | WO2005063816 | 7/2005 |
| WO | WO 05/112919 A2 | 12/2005 |
| WO | WO2005118635 | 12/2005 |
| WO | WO2006020258 | 2/2006 |
| WO | WO 06/034488 | 3/2006 |
| WO | WO2006036834 | 4/2006 |
| WO | WO2006072620 | 7/2006 |
| WO | WO 06/110476 A2 | 10/2006 |
| WO | WO2006106905 | 12/2006 |
| WO | WO2007005612 | 1/2007 |
| WO | WO 07/018431 A2 | 2/2007 |
| WO | WO2007042261 | 4/2007 |
| WO | WO2007047829 | 4/2007 |
| WO | WO 07/059404 A2 | 5/2007 |
| WO | WO2007062037 | 5/2007 |
| WO | WO 07/089149 A2 | 8/2007 |
| WO | WO2007093630 | 8/2007 |
| WO | WO2007098934 | 9/2007 |
| WO | WO2007110205 | 10/2007 |
| WO | WO 2007113648 | 10/2007 |
| WO | WO 07/147901 | 12/2007 |
| WO | WO2008003103 | 1/2008 |
| WO | WO2008003115 | 1/2008 |
| WO | WO2008003116 | 1/2008 |
| WO | WO 08/119566 | 10/2008 |
| WO | WO2008119096 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO 09/017394 A1 | 2/2009 |
| WO | WO2009017823 | 2/2009 |
| WO | WO2009030734 | 3/2009 |
| WO | WO2009032782 | 3/2009 |
| WO | WO 2013/180201 | 6/2009 |
| WO | WO2009089004 | 7/2009 |
| WO | WO2009106096 | 9/2009 |
| WO | WO2009106321 | 9/2009 |
| WO | WO 2010/028796 | 3/2010 |
| WO | WO2010033736 | 3/2010 |
| WO | WO2010034441 | 4/2010 |
| WO | WO2010042904 | 4/2010 |
| WO | WO 10/062171 A2 | 6/2010 |
| WO | WO2010085682 | 7/2010 |
| WO | WO 10/106180 | 9/2010 |
| WO | WO 2010/0112193 | 10/2010 |
| WO | WO 2010/115551 | 10/2010 |
| WO | WO 2010/115552 | 10/2010 |
| WO | WO 2010/115553 | 10/2010 |
| WO | WO2010115589 | 10/2010 |
| WO | WO2010119119 | 10/2010 |
| WO | WO2011133886 | 10/2010 |
| WO | WO2010151792 | 12/2010 |
| WO | WO2010151808 | 12/2010 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011143545 | 11/2011 |
| WO | WO 12/016227 | 2/2012 |
| WO | WO2012018687 | 2/2012 |
| WO | WO2012032080 | 3/2012 |
| WO | WO 12/058768 | 5/2012 |
| WO | WO2012058768 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146628 | 11/2012 |
| WO | WO2012162067 | 11/2012 |

(56) References Cited

FOREIGN PATENT DOCUMENTS

| | | |
|---|---|---|
| WO | WO2013006544 | 1/2013 |
| WO | WO2013016714 | 1/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2014004586 | 1/2014 |
| WO | WO2014012085 | 1/2014 |
| WO | WO 2014079000 | 5/2014 |
| WO | WO 2014/110601 | 7/2014 |
| WO | WO 2014/113510 | 7/2014 |
| WO | WO 2014/145806 | 9/2014 |
| WO | WO 2014/145907 | 9/2014 |
| WO | WO 2014/164553 | 10/2014 |
| WO | WO 2015/063339 | 5/2015 |
| WO | WO 2015/149077 | 10/2015 |
| WO | WO 2016014984 | 1/2016 |
| WO | WO 2016086186 | 6/2016 |
| WO | WO 2016086189 | 6/2016 |
| WO | WO 2016086196 | 6/2016 |
| WO | WO 2016105450 | 6/2016 |

OTHER PUBLICATIONS

Hennecke et al (Protein Eng, 1998, 11(5): 405-410).*
Ridgeway et al (Protein Engineering, 1996, 9(7): 617-621).*
Reddy et al., Elimination of Fc receptor-dependent effector functions of a modified IgG4 monoclonal antibody to human CD4., J Immunol. Feb. 15, 2000;164(4):1925-33.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Bargou et al., Tumor Regression in Cancer Patients by Very Low Doses of a T Cell-Engaging Antibody, Science, 2008, vol. 321, pp. 974-977.

Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/ CD3 Stimulation Is a Function of the Anti-CD3 Antibody Isotype, Jul. 30, 2008.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chelius, et al., Structural and functional characterization of the trifunctional antibody catumaxomab, mAbs, 2010, vol. 2, Issue 3, pp. 309-319.
Chothia, et al., Structural Determinants in the Sequences of Immunoglobulin Variable Domain, J. Mol. Biol., 1998, vol. 278, pp. 457-479.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.

(56) References Cited

OTHER PUBLICATIONS

DiGiammarino et al., Ligand association rates to the inner-variable-domain of a dual-variable-domain immunoglobulin are significantly impacted by linker design, mAbs3:5, 1-8; Sep-Oct; 3(5):487-94, Landes Bioscience, Sep. 1, 2011.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

Foreman, et al., ErbB3 Inhibitory Surrobodies Inhibit Tumor Cell Proliferation In Vitro and In Vivo, Mol Cancer Ther, 2012, vol. 11(7) , pp. 1411-1420.

Foreman, et al., PEGS poster, "ErbB3 Inhibitory Surrobodies Inhibit Tumor Cell Proliferation In Vitro and In Vivo," 2012.

Francois, et al., Construction of a Bispecific Antibody Reacting with the α-and ß-Chains of the Human IL-2 Receptor, The Journal of Immunology, May 15, 1993, vol. 150, No. 10, pp. 4610-4619.

F-star Modular Antibodies Fact Sheet, Apr. 2008, "Modular Antibody Technology" (w/ reference to Ruker WO 2006/072620 A1).

F-star Modular Antibodies Press Release, Mar. 28, 2008, "Antibody Engineering Company F-Star Buys Back Royalty Obligations. TVM Capital Joins Investor Syndicate."

Fudenberg, et al., Serologic Demonstration of Dual Specificity of Rabbit Bivalent Hybrid Antibody, The Journal of Experimental Medicine, 1964, vol. 119(1), pp. 151-166.

Ganesan et al., FcγRIIb on Liver Sinusoidal Endothelium Clears Small Immune Complexes., The Journal of Immunology, Nov. 15, 2012, vol. 189 No. 10 4981-4988.

GenBank AAA38124.1, immunoglobulin heavy-chain VJ region [Mus musculus] Protein/NCBI.

GenBank AAA39180.1, immunoglobulin light-chain VJ region [Mus musculus] Protein/NCBI.

Ghendler et al., One of the CD3ε Subunits within a T Cell Receptor Complex Lies in Close Proximity to the Cß FG Loop, J. Exp. Med., 1998, vol. 187, No. 9. pp. 1529-1536.

Gilliland, et al., Universal bispecific antibody for targeting tumor cells for destruction by cytotoxic T cells, Proc. Natl. Acad. Sci. USA, 1988, vol. 85, pp. 7719-7723.

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.

Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hamel, et al., The Role of the $V_L$- and $V_H$-Segments in the Preferential Reassociation of Immunoglobulin Subunits, Molecular Immunology, 1986, vol. 23, No. 5, pp. 503-510.

Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.

Hexham, et al., Influence of relative binding affinity on efficacy in a panel of anti-CD3 scFv immunotoxins, Molecular Immunology, 2001, vol. 38, pp. 397-408.

Hoffmann, et al., Serial killing of tumor cells by cytotoxic T cells redirected with a CD19-/CD3-bispecific single-chain antibody construct, Int. J. Cancer, 2005, vol. 115, pp. 98-104.

Houtenbos, et al., The novel bispecific diabody αCD40/αCD28 strengthens leukaemic dendritic cell-induced T-cell reactivity, British Journal of Haematology, 2008, vol. 142, pp. 273-283.

Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.

Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.

Jespers, et al., Crystal Structure of HEL4, a Soluble, Refoldable Human $V_H$ Single Domain with a Germ-line Scaffold, J. Mol. Biol., 2004, vol. 337, pp. 893-903.

Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.

Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.

Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846- 1848.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

Keyna, et al., Surrogate Light Chain-Dependent Selection of Ig Heavy Chain V Regions, J. Immunol., 1995, vol. 155, pp. 5536-5542.

Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.

Kipriyanov, et al., Bispecific CD3 x CD19 Diabody for T Cell-Mediated Lysis of Malignant Human B Cells, Int. J. Cancer, 1998. vol. 77, pp. 763-772.

(56) References Cited

OTHER PUBLICATIONS

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No, 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

(56) References Cited

OTHER PUBLICATIONS

Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.

Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Rattel, et al., AACR Poster, "Validation of Cynomolgus Monkeys as Relevant Species for Safety Assessment of a Novel Human BiTE Antibody Platform for Cancer Therapy," 2010.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riethmüller, Symmetry breaking: bispecific antibodies, the beginnings, and 50 years on, Cancer Immunity, 2012, vol. 12, p. 12, pp. 1-7.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3-Surface Expression Is Required for CD4-p56lck-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

(56) References Cited

OTHER PUBLICATIONS

Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/ß T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Strop, P. et al., Generating Bispecific Human IgG1 and IgG2 Antibodies from Any Antibody Pair, J. Mol. Biol., 2012, doi:10.1016/j.jmb.2012.04.020.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.

Traunecker, et al., Bispecific single chain molecules (Janusins) target cytotoxic lymphocytes on HIV infected cells, The EMBO Journal, 1991, vol. 1, No. 12, pp. 3655-3659.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

Van Boxel, et al., Some lessons from the systematic production and structural analysis of soluble αβ T-cell receptors, Journal of Immunological Methods, 2009, vol. 350, pp. 14-21.

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6, No. 8, pp. 989-995.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-lg™) molecules, Jul.-Aug. 2009; 339-347, Oct. 14, 2007.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296, pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

(56) References Cited

OTHER PUBLICATIONS

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zuo, et al., An efficient route to the production of an IgG-like bispecific antibody, Protein Engineering, 2000, vol. 13, No. 5, pp. 361-367.

U.S. Appl. No. 12/875,015, 2011-0054151, filed Sep. 2, 2010, Mar. 2011.

U.S. Appl. No. 13/648,951, 2013-0171095, filed Oct. 10, 2012, Jul. 4, 2013.

U.S. Appl. No. 13/194,904, 2012-0028304, U.S. Pat. No. 8,637,641, filed Jul. 29, 2011, Feb. 2, 2012, Jan. 28, 2014.

U.S. Appl. No. 14/165,487, 2014-0249297, filed Jan. 27, 2014, Sep. 4, 2014.

U.S. Appl. No. 13/568,028, filed Aug. 6, 2012.

U.S. Appl. No. 14/853,622, 2016-0068588, filed Sep. 14, 2015, Mar. 10, 2016.

U.S. Appl. No. 13/887,234, filed May 3, 2013.

U.S. Appl. No. 14/156,431, 2014-0212435, filed Jan. 15, 2014, Jul. 31, 2014.

U.S. Appl. No. 14/156,432, 2014-0212436, filed Jan. 15, 2014, Jul. 31, 2014.

U.S. Appl. No. 14/808,826, 2016-0060360, filed Jul. 24, 2015, Mar. 3, 2016.

U.S. Appl. No. 14/155,248, 2014-0322217, filed Jan. 14, 2014, Oct. 30, 2014.

U.S. Appl. No. 14/155,334, 2014-0370013, filed Jan. 14, 2014, Dec. 18, 2014.

U.S. Appl. No. 14/155,344, 2014-0294833, filed Jan. 14, 2014, Oct. 2, 2014.

U.S. Appl. No. 14/205,227, 2014-0294835, filed Mar. 11, 2014, Oct. 2, 2014.

U.S. Appl. No. 14/205,248, 2014-0288275, filed Mar. 11, 2014, Sep. 25, 2014.

U.S. Appl. No. 14/214,418, 2014-0356381, filed Mar. 14, 2014, Dec. 4, 2014.

U.S. Appl. No. 14/214,475, 2014-0294836, filed Mar. 14, 2014, Oct. 2, 2014.

U.S. Appl. No. 14/217,166, 2014-0294759, filed Mar. 17, 2014, Oct. 2, 2014.

U.S. Appl. No. 14/200,652, 2014-0302064, filed Mar. 7, 2014, Oct. 9, 2014.

U.S. Appl. No. 14/207,489, 2014-0377270, filed Mar. 12, 2014, Dec. 25, 2014.

U.S. Appl. No. 14/210,236, 2015-0071948, filed Mar. 13, 2014, Mar. 12, 2015.

U.S. Appl. No. 14/200,821, 2014-0294823, filed Mar. 7, 2014, Oct. 2, 2014.

U.S. Appl. No. 14/216,705, 2014-0363426, filed Mar. 17, 2014, Dec. 11, 2014.

U.S. Appl. No. 14/673,695, 2015-0307629, filed Mar. 30, 2015, Oct. 29, 2015.

U.S. Appl. No. 14/952,705, filed Nov. 25, 2015.

U.S. Appl. No. 14/952,714, filed Nov. 25, 2015.

U.S. Appl. No. 15/141,350, filed Apr. 28, 2016.

U.S. Appl. No. 14/952,786, filed Nov. 25, 2015.

U.S. Appl. No. 14/757,809, filed Dec. 22, 2015.

U.S. Appl. No. 15/063,441, filed Mar. 7, 2016.

U.S. Appl. No. 12/875,015, filed Sep. 2, 2010.

U.S. Appl. No. 13/648,951, filed Oct. 10, 2012.

U.S. Appl. No. 13/194,904, filed Jul. 29, 2011, U.S. Pat. No. 8,637,641.

U.S. Appl. No. 14/165,487, filed Jan. 27, 2014.

U.S. Appl. No. 14/155,248, filed Jan. 14, 2014.

U.S. Appl. No. 14/155,334, filed Jan. 14, 2014.

U.S. Appl. No. 14/155,344, filed Jan. 14, 2014.

U.S. Appl. No. 14/205,227, filed Mar. 11, 2014.

U.S. Appl. No. 14/205,248, filed Mar. 11, 2014.

U.S. Appl. No. 14/214,418, filed Mar. 14, 2014.

U.S. Appl. No. 14/200,652, filed Mar. 7, 2014.

U.S. Appl. No. 14/207,489, filed Mar. 12, 2014.

U.S. Appl. No. 14/200,821, filed Mar. 7, 2014.

U.S. Appl. No. 14/216,705, filed Mar. 17, 2014.

U.S. Appl. No. 14/156,431, filed Jan. 15, 2014.

U.S. Appl. No. 14/156,432, filed Jan. 15, 2014.

U.S. Appl. No. 12/631,508, filed Dec. 4, 2009, Chari et al.

"Polythene Glycol and Derivatives for Advanced PEGylation", Catalog 2005-2006, Nektar Therapeutics.

Aplin et al., , Preparation, properties, and applications of carbohydrate conjugates of proteins and lipids, 1981, CRC Crit. Rev. Biochem., pp. 259-306.

Baca et al., Antibody humanization using monovalent phage display, 1997, J. Biol. Chem. 272(16):10678-10684.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Biochemica, Your apoptosis specialist, 1999, No. 2, pp. 34-37 (Roche Molecular Biochemicals).

Bird et al., Single-chain antigen-binding proteins, 1988, Science 242:423-426.

Carter et al., Humanization of an anti-p185HER2 antibody for human cancer therapy, 1992, Proc Natl Acad Sci USA 89:4285-9.

Carter et al., Antibody-drug conjugates for cancer therapy, 2008, Cancer J. 14(3):154-169.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

Chothia et al., Canonical structures for the hypervariable regions of immunoglobulins, 1987, J. Mol. Biol. 196:901-917.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Doronina , Development of potent monoclonal antibody auristatin conjugates for cancer therapy, 2003, Nat Biotechnol 21(7):778-784.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Duke, et al., Measurement of apoptosis and other forms of cell death, 2004, Curr protocols immunol. 3.17.1-3.17.16.

Duksin et al., Relationship of the structure and biological activity of the natural homologues of tunicamycin, 1982, J. Biol. Chem. 257:3105.

Edge et al., Deglycosylation of glycoproteins by trifluoromethanesulfonic acid, 1981, Anal. Biochem. 118:131.

Fraker et al., Crystal structure of peptide cyclo-(D-VAL-L-PRO-L-VAL-D-PRO)$_3$, 1978, Biochem. Biophys. Res. Commun. 80(4):849-57.

(56) References Cited

OTHER PUBLICATIONS

Ghetie et al., Multiple roles for the major histocompatibility complex Class I-related receptor FcRn, 2000, Annu Rev Immunol 18:739-766.
Gorman et al., Reshaping a therapeutic CD4 antibody, Proc. Natl. Acad. Sci. USA 88:4181-4185.
Hakimuddin et al., A chemical method for the deglycosylation of proteins, 1987, Arch. Biochem. Biophys. 259:52.
Hawkins et al, Selection of phage antibodies by binding affinity mimicking affinity maturation, 1992, J. Mol. Biol. 226:889-896.
He et al., Humanization and pharmacokinetics of a monoclonal antibody with specificity for both E- and P-selectin, 1998, J. Immunol. 160:1029-1035.
Hinman et al., Preparation and characterization of monoclonal antibody conjugates of the calicheamicins: a novel and potent family of antitumor antibodies, 1993 Cancer Res. 53:3336-3342.
Holliger et al., Engineering bispecific antibodies, 1993, Current Opinion Biotechnol. 4:446-449.
Holliger et al., "Diabodies": Small Bivalent and bispecific antibody fragments, 1993, Proc. Natl. Acad. Sci. U.S.A. 90:6444-6448.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Jackson et al., In vitro antibody maturation, 1995, J. Immunol. 154(7):3310-9.
Jefferis et al., Interaction sites on human IgG-Fc for FcγR: current models, 2002, Immunol Lett 82:57-65.
Johnson et al., Anti-tumor activity of CC49-doxorubicin immunoconguates, 1995, Anticancer Res. 15:1387-93.
Jones et al., Replacing the complementarity-determining regions in a human antibody with those from a mouse, 1986, Nature 321:522-525.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kettleborough et al., Humanization of a mouse monoclonal antibody by CDR-grafting: the importance of framework residues on loop conformation, 1991, Protein Eng. 4(7):773-83.
Klein et al., Progression of metastatic human prostate cancer to androgen independence in immunodeficient SDIC mice, 1997, Nature Medicine 3: 402-408.
Krauss et al., Specificity grafting of human antibody frameworks selected from a phage display library: generation of a highly stable humanized anti-CD22 single-chain Fv fragment, 2003, Protein Engineering 16(10):753-759.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Liu et al., Eradication of large colon tumor xenografts by targeted delivery of maytansinoids, 1996 Proc. Natl. Acad. Sci. USA 93:8618-8623.
Lode et al., Targeted therapy with a novel enediyene antibiotic calicheamicins $o^I_1$ effectively suppress growth and dissemination of liver metastases in a syngeneic model of murine neuroblastoma, 1998, Cancer Res. 58:2928.
Mandler et al., Synthesis and evaluation of antiproliferative activity of a geldanaymcin-herceptin™ immunoconjugates, 2000, Bioorganic & Med. Chem. Letters 10:1025-1028.
Mandler et al., Modifications in synthesis strategy improve the yield and efficacy of geldanamycin-herceptin immunoconjugates, 2002, Bioconjugate Chem. 13:786-791).
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Marks et al., By-passing immunization: building high affinity human antibodies by chain shuffling, 1992, Biotechnology 10:779-783.
Mateo et al, Humanization of a mouse nonoclonal antibody that blocks the epidermal growth factor receptor: recovery of antagonistic activity, 1997, Immunotechnology, 3(1):71-81.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., The human EGF receptor as a target for cancer therapy: six new rat mAbs against the receptor on the breast carcinoma MDA-MB 468, 1993, Br J Cancer. 1993, 67(2):247-53.
Modjtahedi et al., Antitumor activity of combinations of antibodies directed against different epitopes on the extracellular domain of the human EGF receptor, 1993, J. Cell Biophys. 1993, 22(1-3):129-46.
Mosmann, 1983, Rapid colorimetric assay for cellular growth and survival: application to proliferation and cytotoxicity assays, J. Immunol. Methods 65:55-63.
Murthy et al., Binding of an antagonistic monoclonal antibody to an intact and fragmented EGF-receptor polypeptide, 1987, Arch Biochem Biophys. 252(2):549-60.
Neville et al., Enhancement of immunotoxin efficacy by acid-cleavable cross-ling agents utilizing diphtheria toxin and toxin mutants, 1989, Biol. Chem. 264:14653-14661.
O'Connor et al., Humanization of an antibody against human protein C and calcium-dependence involving framework residues, 1998, Protein Eng 11:321-8.
Page et al., 1993, Intermantional. Journal of Oncology 3:473-476.
Pettit et al., Structure-activity studies with chiral isomers and with segments of the antimitotic marine peptide dolastatin 10, 1989, J. Am. Chem. Soc. 111:5463-5465.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Antineoplastic agents 365. Dolastatin 10 SAR probes, 1998, Anti-Cancer Drug Design 13:243-277.
Pettit et al., Specific activities of dolastatin 10 and peptide derivatives against Cryptococcus neoformans, 1998, Antimicrob. Agents Chemother. 42(11):2961-2965.
Pettit, et al., The dolastatins; 18: Sterospecific synthesis of dolaproine1, 1996, Synthesis 719-725.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Remington's Pharmaceutical Sciences 16th edition, Osol, A. Ed. (1980) (Book Abstract).
Riechmann et al., Reshaping human antibodies for therapy, 1988, Nature 332:323-329.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roque et al., Antibodies and genetically engineered related molecules: production and purification, 2004, Biotechnol. Prog. 20:639-654.

(56) References Cited

OTHER PUBLICATIONS

Rosok et al., A combinatorial library strategy for the rapid humanization of anticarcinoma BR 96 Fab, 1996, J. Biol. Chem. 271(37): 22611-22618.
Schroder et al., The Peptides, vol. pp. 76-136, 1965, Academic Press.
Senter, Potent antibody drug conjugates for cancer therapy, 2009, Current Opin. Chem. Biol. 13:235.
Senter et al, Proceedings of the American Association for Cancer Research, 2004, vol. 45, Abstract No. 623.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Tan et al., "Superhumanized" antibodies: reduction of immunogenic potential by complementarity-determining region grafting with human germline sequences: application to an anti-CD28, 2002, J. Immunol. 169:1119-1125.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Tomlinson et. al., Methods for generating multivalent and bispecific antibody fragments, 2000, Methods Enzymol. 326:461-479.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Verhoeyen et al., Reshaping human antibodies: grafting an antilysozyme activity, 1988, Science, 239:1534-1536.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Woyke et al., In vitro activities and postantifungal effects of the potent dolastation 10 derivative auristatin PHE, 2001, Antimicrob. Agents and Chemother. 45(12):3580-3584.
Wu et al., Humanization of a murine monoclonal antibody by simultaneous optimization of framework and CDR residues, 1999, J. Mol. Biol. 294:151-162.
Yelton et al., Affinity maturation of the BR96 anti-carcinoma antibody by codon-based mutagenesis, 1995, J. Immunol. 155:1994-2004.
Yu et al., The biosynthetic gene cluster of the maytansinoids antitumor agent ansamitocin from actinosynnema pretiosum, 2002, PNAS 99:7968-7973.
Boswell et al., Effects of Charge on Antibody Tissue Distribution and Pharmacokinetics, 2010, Bioconjugate Chem, 21(21):2153-2163.
De Groot et al., De-Immunization of Therapeutic Proteins by T-Cell Epitope Modification, 2005, Dev. In Biologicals, 2005, 122:171-194.
Kim et al., "Localization of the site of murine IgG1 molecule that is involved in binding the murine intestinal Fc receptor," Eur. J. Immunol., 24:2429-2434, 1994.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Del Nagro et al., A critical role for complement C3d and the B cell coreceptor (CD19/CD21) complex in the initiation of inflammatory arthritis., J Immunol. Oct. 15, 2005;175(8):5379-89.
Fischer, Nicolas et al., "Bispecifc antibodies: molecules that enable novel therapeutic strategies", 2007, vol. 74, pp. 3-14.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Michaelson, J.S. et al., "Anti-tumor activity of stability-engineered IgG-like bispecific antibodies targeting TRAIL-R2 and LTβR", mAbs 1[2]:128-141, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
(No Author Name) "A method for making multispecific antibodies having heteromultimeric and common components", Expert Opinion on Therapeutic Patents, Genentech, Inc. (1999) 9(6): 785-790, pp. 785-790.
Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Stewart, et al., Recombinant CD36 inhibits oxLDL-induced ICAM-1-dependent monocyte adhesion., Mol Immunol. Feb. 2006;43(3):255-67.
Tedgui, et al., Cytokines in atherosclerosis: pathogenic and regulatory pathways., Physiol Rev. Apr. 2006;86(2):515-81.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thurman et al., Detection of complement activation using monoclonal antibodies against C3d., J Clin Invest. May 2013;123(5):2218-30. doi: 10.1172/JCI65861. Epub Apr. 24, 2013.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Bortoletto, Nicola et al., "Optomizing anti-CD3 affinity for effective T cell targeting against tumor cells.", Eur J Immunol. Nov. 2002;32(11):3102-7.
Mertens, Nico, "Tribodies: Fab-scFv fusion proteins as a platform to create multi-functional pharmaceuticals.", SpringerLink 2011, 135-149.
Kuppen, Peter et al., The development and purification of a bispecific antibody for lymphokine-activated killer cell targeting against the rat colon carcinoma CC531., Cancer Immunol Immunother. Jun. 1993;36(6):403-8.
Counterman et al., "Volumes of Individual Amino Acid Residues in Gas-Phase Peptide Ions.", J. Am. Chem. Soc., 1999, 121 (16), pp. 4031-4039.

(56) References Cited

OTHER PUBLICATIONS

Grodzki & Bernstein, "Antibody Purification: Ion-Exchange Chromatography.", Methods Mol Biol 2010 ;588:27-32.
Hennecke et al., "Non-repetitive single-chain Fv linkers selected by selectively infective phage (SIP) technology.", Protein Eng. May 1998;11(5):405-10.
Lazar Declaration, Dec. 27, 2010, pp. 1-4.
Jin et al. The Design and Engineering of IgG-Like Bispecific Antibodies., Chapter 9, Bispecific Antibodies, pp. 151-169.
Zamyatnin AA., Amino Acid, Peptide, and Protein Volume In Solution., Annu Rev Biophys Bioeng. 1984;13:145-65.
Zalevsky et al. "Enhanced antibody half-life improves in vivo activity." Nature Biotechnology, vol. 28, No. 2, Feb. 1, 2010, pp. 157-159.
U.S. Appl. No. 15/185,958, filed Jun. 17, 2016.
U.S. Appl. No. 15/186,167, filed Jun. 17, 2016.
U.S. Appl. No. 12/875,015, Restriction Requirement, dated May 24, 2012.
U.S. Appl. No. 12/875,015, Non-Final Rejection, dated Sep. 17, 2012.
U.S. Appl. No. 12/875,015, Final Rejection, dated May 30, 2013.
U.S. Appl. No. 12/875,015, Non-Final Rejection, dated Dec. 17, 2015.
U.S. Appl. No. 12/875,015, Notice of Allowance, dated Jul. 1, 2016.
U.S. Appl. No. 13/648,951, Restriction Requirement, dated Apr. 23, 2013.
U.S. Appl. No. 13/648,951, Non-Final Rejection, dated Jan. 3, 2014.
U.S. Appl. No. 13/648,951, Final Rejection, dated Jan. 2, 2015.
U.S. Appl. No. 13/648,951, Non-Final Rejection, dated Feb. 11, 2016.
U.S. Appl. No. 13/194,904, Restriction Requirement, dated Sep. 14, 2012.
U.S. Appl. No. 13/194,904, Non-Final Rejection, dated Dec. 14, 2012.
U.S. Appl. No. 13/194,904, Notice of Allowance, dated Sep. 18, 2013.
U.S. Appl. No. 14/165,487, Restriction Requirement, dated Apr. 4, 2016.
U.S. Appl. No. 14/165,487, Notice of Allowance, dated Nov. 8, 2016.
U.S. Appl. No. 13/568,028, Restriction Requirement, dated Sep. 2, 2014.
U.S. Appl. No. 13/568,028, Non-Final Rejection, dated Mar. 12, 2015.
U.S. Appl. No. 14/156,431, Restriction Requirement, dated Mar. 30, 2016.
U.S. Appl. No. 14/156,431, Non-Final Rejection, dated Jun. 23, 2016.
U.S. Appl. No. 14/156,432, Restriction Requirement, dated Oct. 6, 2015.
U.S. Appl. No. 14/156,432, Non-Final Rejection, dated Feb. 23, 2016.
U.S. Appl. No. 14/156,432, Non-Final Rejection, dated Aug. 11, 2016.
U.S. Appl. No. 14/155,248, Restriction Requirement, dated Nov. 19, 2015.
U.S. Appl. No. 14/155,248, Non-Final Rejection, dated Jun. 23, 2016.
U.S. Appl. No. 14/155,334, Restriction Requirement, dated Nov. 20, 2015.
U.S. Appl. No. 14/155,334, Non-Final Rejection, dated Jun. 22, 2016.
U.S. Appl. No. 14/155,344, Restriction Requirement, dated Nov. 20, 2015.
U.S. Appl. No. 14/155,344, Non-Final Rejection, dated Sep. 2, 2016.
U.S. Appl. No. 14/205,227, Restriction Requirement, dated Apr. 29, 2015.
U.S. Appl. No. 14/205,227, Non-Final Rejection, dated Sep. 18, 2015.
U.S. Appl. No. 14/205,227, Final Rejection, dated Nov. 25, 2015.
U.S. Appl. No. 14/205,227, Non-Final Rejection, dated May 10, 2016.
U.S. Appl. No. 14/205,248, Restriction Requirement, dated Nov. 20, 2015.
U.S. Appl. No. 14/205,248, Notice of Allowance, dated Jun. 29, 2016.
U.S. Appl. No. 14/214,418, Restriction Requirement, dated Mar. 23, 2016.
U.S. Appl. No. 14/214,475, Restriction Requirement, dated Sep. 3, 2015.
U.S. Appl. No. 14/214,475, Non-Final Rejection, dated Apr. 7, 2016.
U.S. Appl. No. 14/214,475, Final Rejection, dated Nov. 1, 2016.
U.S. Appl. No. 14/217,166, Restriction Requirement, dated Aug. 27, 2015.
U.S. Appl. No. 14/217,166, Non-Final Rejection, dated Apr. 20, 2016.
U.S. Appl. No. 14/200,652, Restriction Requirement, dated Dec. 3, 2015.
U.S. Appl. No. 14/200,652, Non-Final Rejection, dated Jun. 30, 2016.
U.S. Appl. No. 14/207,489, Restriction Requirement, dated Dec. 14, 2015.
U.S. Appl. No. 14/207,489, Non-Final Rejection, dated Aug. 31, 2016.
U.S. Appl. No. 14/210,236, Restriction Requirement, dated May 19, 2016.
U.S. Appl. No. 14/200,821, Non-Final Rejection, dated Apr. 29, 2015.
U.S. Appl. No. 14/200,821, Final Rejection, dated Feb. 11, 2016.
U.S. Appl. No. 14/200,821, Notice of Allowance, dated Nov. 18, 2016.
U.S. Appl. No. 14/216,705, Restriction Requirement, dated Jun. 30, 2016.
U.S. Appl. No. 14/216,705, Non-Final Rejection, dated Aug. 5, 2016.
WO 2011/028952—PCT/US2010/047741 International Search Report dated Dec. 14, 2010.
WO 2013/055809—PCT/US12/59582 International Search Report dated Mar. 13, 2013.
WO 2012/016227—PCT/US11/46041 International Search Report dated Mar. 15, 2012.
WO 2013/022855—PCT/US12/49789 International Search Report dated Dec. 18, 2012.
WO 2014/113510—PCT/US14/11741 International Search Report dated Jun. 6, 2014.
WO 2016/014984—PCT/US15/42072 International Search Report dated Nov. 4, 2015.
WO 2014/110601—PCT/US14/11549 International Search Report and Written Opinion of the International Searching Authority dated May 7, 2014.
WO 2014/145907—PCT/US14/30758 International Search Report dated Aug. 6, 2014.
WO 2014/145806—PCT/US14/30634 International Search Report dated Jan. 9, 2015.
WO 2015/149077—PCT/US15/23411 International Search Report dated Sep. 2, 2015.
WO 2016/086186—PCT/US15/62769 International Search Report dated Jun. 24, 2016.
WO 2016/086189—PCT/US15/62772 International Search Report dated Jul. 18, 2016.
WO 2016/086196—PCT/US15/62786 62772 International Search Report dated Jun. 22, 2016.
WO 2016/105450—PCT/US15/00155 62772 International Search Report dated Jul. 20, 2016.
WO 2016/141387—PCT/US16/21277 International Search Report dated Jun. 28, 2016.

* cited by examiner

Figure 4A

Preferred steric variants that favor Fc heterodimerization.

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 4B

Specifically preferred steric variants that favor Fc heterodimerization.

| Variant 1 | Variant 2 |
|---|---|
| F405A | T394F |
| S364D | Y349K |
| S364E | Y349K |
| S364H | Y349T |
| L351K | L351E |
| D401K | T411E |
| S364D/T394F | Y349K/F405A |
| S364E/F405A | Y349K/T394F |
| S364H/D401K | Y349T/T411E |
| S364H/F405A | Y349T/T394F |
| S364H/T394F | Y349T/F405A |
| L351K/S364H/D401K | Y349T/L351E/T411E |
| S364H/D401K/F405A | Y349T/T394F/T411E |
| S364H/F405A/T411E | Y349T/T394F/D401K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 5A

PREFERRED HETERODIMERIZATION VARIANTS

| Fc monomer 1 substitutions | Fc monomer 2 substitutions |
|---|---|
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |
| Q347E/K360E | Q347R |
| L368E | S364K |
| I199T/N203D/K247Q/R355Q/N384S/K392N/V397M/Q419E/K447_ (deletion of K447) | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| Y349T | S364H |
| T394F | F405A |
| Y349T/T394F | S364H/F405A |
| K370E | T411K |
| K370E/T411D | T411K |
| K370E/T411E | K370R/T411K |
| L368E/K409E | L368K |
| Y349T/T411E | S364H/D401K |
| Y349T/T394F/S354C | S364H/F405A/Y349C |
| T411E | D401K |
| T411E | D401R/T411R |

Figure 5B

| | |
|---|---|
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |

Figure 6

| Fc monomer 1 substitutions | Fc monomer 2 substitutions |
|---|---|
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N203D/K247Q/R355Q/N384S/K392N/V397M/Q419E/K447_ | Q196K/P217R/P228R/N276K |
| N203D/K247Q/R355Q/N384S/K392N/V397M/Q419E/K447_ | Q196K/N276K |
| N203D/K247Q/R355Q/N384S/K392N/Q419E/K447_ | Q196K/P217R/P228R/N276K |
| N203D/K247Q/R355Q/N384S/K392N/Q419E/K447_ | Q196K/N276K |

Figure 7A

XENP11874 HC-Fab SEQ ID NO:441
EVQLVESGGGLVKPGGSLKLSCAASGYTFTSYVMHWVRQAPGKGLEWIGYINPYNDGTKYNEKFQGRVTISS
DKSISTAYMELSSLRSEDTAMYYCARGTYYYGTRVFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLRGPSVFLFPPKPKDTLMISRTPEVTCVVVDVSHEDPEVKFNWYVDGVEV
HNAKTKPREEQYNSTYRVVSVLTVLHQDWLNGKEYKCKVSNKARPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVM
HEALHNHYTQKSLSLSPGK

XENP11874 HC-scFv SEQ ID NO:442
EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSSGGGGSGGGGSGGGGSQAVV
TQEPSLTVSPGGTVTLTCGSSTGAVTTSNYANWVQQKPGQAPRGLIGGTNKRAPGVPARFSGSLLGGKAALT
LSGAQPEDEAEYYCALWYSNLWVFGGGTKLTVLERKSSDKTHTCPRCPAPELLRGPSVFLFPPKPKDTLMIS
RTPEVTCVVVDVSHEDPEVKFKWYVDGVEVHNAKTKPREEQYNSTYRVVSVLTVLHQDWLNGKEYKCKVSNK
ARPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK

XENP11874 LC SEQ ID NO:443
DIVMTQSPATLSLSPGERATLSCRSSKSLQNVNGNTYLYWFQQKPGQSPQLLIYRMSNLNSGVPDRFSGSGS
GTEFTLTISSLEPEDFAVYYCMQHLEYPITFGAGTKLEIKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKSFNR
GEC

XENP11924 HC-Fab SEQ ID NO:444
EVQLVESGGGLVKPGGSLKLSCAASGYTFTSYVMHWVRQAPGKGLEWIGYINPYNDGTKYNEKFQGRVTISS
DKSISTAYMELSSLRSEDTAMYYCARGTYYYGTRVFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYTCNVDHKPSNTKVD
KKVEPKSCDKTHTCPPCPAPELLRGPSVFLFPPKPKDTLMISRTPEVTCVVVDVSHEDPEVQFNWYVDGVEV
HNAKTKPREEQYNSTYRVVSVLTVLHQDWLNGKEYKCKVSNKARPAPIEKTISKAKGQPREPQVYTLPPSQE
EMTKNQVSLTCLVKGFYPSDIAVEWESSGQPENNYNTTPPMLDSDGSFFLYSKLTVDKSRWQEGNVFSCSVM
HEALHNHYTQKSLSLSPG

Figure 7B

XENP11924 HC-scFv SEQ ID NO:445
EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSSGGGGSGGGGSGGGGSQAVV
TQEPSLTVSPGGTVTLTCGSSTGAVTTSNYANWVQQKPGQAPRGLIGGTNKRAPGVPARFSGSLLGGKAALT
LSGAQPEDEAEYYCALWYSNLWVFGGGTKLTVLERKSSDKTHTCPRCPAPELLRGPSVFLFPPKPKDTLMIS
RTPEVTCVVVDVSHEDPEVKFKWYVDGVEVHNAKTKPREEQYNSTYRVVSVLTVLHQDWLNGKEYKCKVSNK
ARPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK

XENP11924 LC SEQ ID NO: 446
DIVMTQSPATLSLSPGERATLSCRSSKSLQNVNGNTYLYWFQQKPGQSPQLLIYRMSNLNSGVPDRFSGSGS
GTEFTLTISSLEPEDFAVYYCMQHLEYPITFGAGTKLEIKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKSFNR
GEC

Figure 8

Humanized Anti-CD3 VH with Kabat CDRs underlined SEQ ID NO: 447
EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSS Humanized Anti-CD3 VL with Kabat CDRs underlined SEQ ID NO: 448
QAVVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL

Figure 13

XENP11925 HC-Fab SEQ ID NO: 449

EVQLVESGGGLVQPGGSLRLSCAASGFDFSRSWMNWVRQAPGKGLEWVSEINPDSSTINYATSVKGRFTISR
DNSKNTLYLQMNSLRAEDTAVYYCARYGNWFPYWGQGTLVTVSSASTKGPSVFPLAPSSKSTSGGTAALGCL
VKDYFPEPVTVSWNSGALTSGVHTFPAVLQSSGLYSLSSVVTVPSSSLGTQTYTCNVDHKPSNTKVDKKVEP
KSCDKTHTCPPCPAPELLRGPSVFLFPPKPKDTLMISRTPEVTCVVVDVSHEDPEVQFNWYVDGVEVHNAKT
KPREEQYNSTYRVVSVLTVLHQDWLNGKEYKCKVSNKARPAPIEKTISKAKGQPREPQVYTLPPSQEEMTKN
QVSLTCLVKGFYPSDIAVEWESSGQPENNYNTTPPMLDSDGSFFLYSKLTVDKSRWQEGNVFSCSVMHEALH
NHYTQKSLSLSPG

XENP11925 HC-scFv SEQ ID NO: 450

EVQLVESGGGLVQPGGSLRLSCAASGFTFNTYAMNWVRQAPGKGLEWVGRIRSKYNNYATYYADSVKGRFTI
SRDDSKNTLYLQMNSLRAEDTAVYYCVRHGNFGNSYVSWFAYWGQGTLVTVSSGGGGSGGGGSGGGGSQAVV
TQEPSLTVSPGGTVTLTCGSSTGAVTTSNYANWVQQKPGQAPRGLIGGTNKRAPGVPARFSGSLLGGKAALT
LSGAQPEDEAEYYCALWYSNLWVFGGGTKLTVLERKSSDKTHTCPRCPAPELLRGPSVFLFPPKPKDTLMIS
RTPEVTCVVVDVSHEDPEVKFKWYVDGVEVHNAKTKPREEQYNSTYRVVSVLTVLHQDWLNGKEYKCKVSNK
ARPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK

XENP11925 LC SEQ ID NO: 451

DIVMTQSPSSLSASVGDRVTITCRASQNVDTNVAWYQQKPGQSPKALIYSASYRYSGVPDRFTGSGSGTDFT
LTISSLQPEDFATYFCQQYDSYPLTFGGGTKLEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

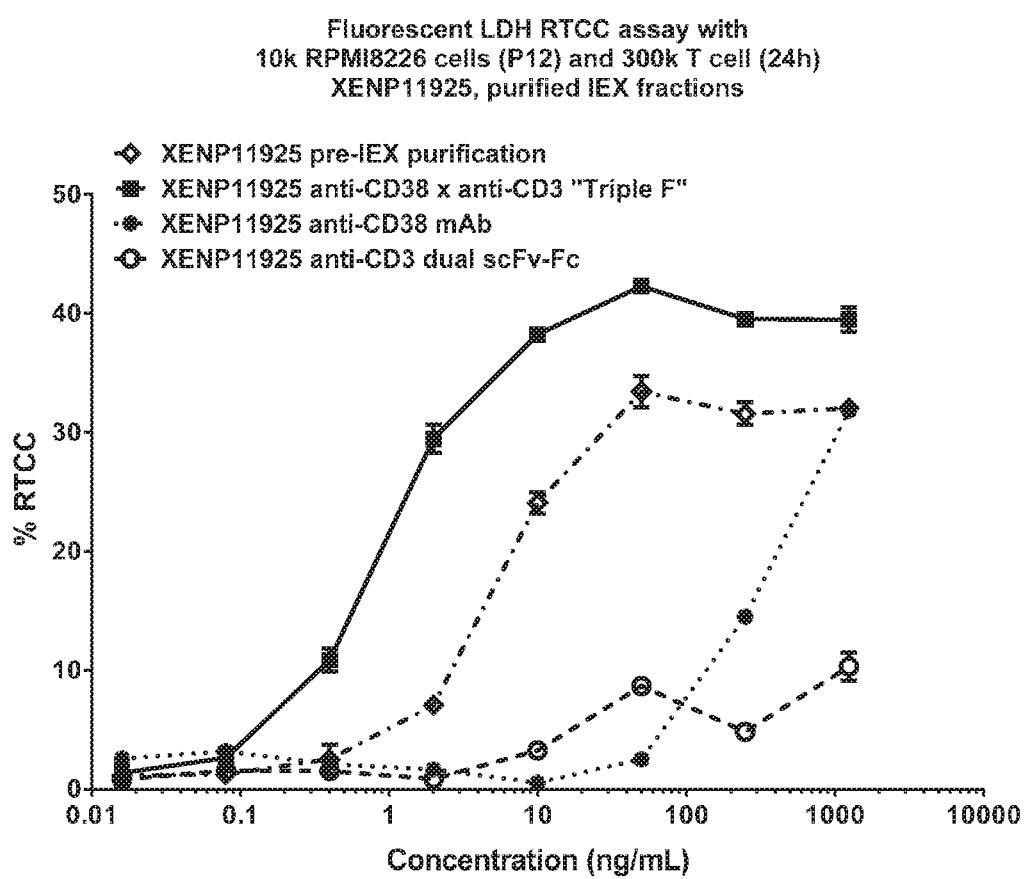

Figure 16A

XENP11924 Heavy Chain HC-Fab SEQ ID NO: 452

EVQLVESGGGLVKPGGSLKLSCAASGYTFTSYVMHWVRQAPGKGLEWIGYINPYNDGTKYNEKFQGRVTI
SSDKSISTAYMELSSLRSEDTAMYYCARGTYYYGTRVFDYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYTCNVDHKP
SNTKVDKKVEPKSCDKTHTCPPCPAPELLRGPSVFLFPPKPKDTLMISRTPEVTCVVVDVSHEDPEVQFN
WYVDGVEVHNAKTKPREEQYNSTYRVVSVLTVLHQDWLNGKEYKCKVSNKARPAPIEKTISKAKGQPREP
QVYTLPPSQEEMTKNQVSLTCLVKGFYPSDIAVEWESSGQPENNYNTTPPMLDSDGSFFLYSKLTVDKSR
WQEGNVFSCSVMHEALHNHYTQKSLSLSPG

XENP11924 Heavy Chain HC-scFv SEQ ID NO: 453

EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLERKSSDKTHTCPRCPAPELLRGPSVFLFPPK
PKDTLMISRTPEVTCVVVDVSHEDPEVKFKWYVDGVEVHNAKTKPREEQYNSTYRVVSVLTVLHQDWLNG
KEYKCKVSNKARPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

XENP12152 Heavy Chain HC-Fab (T411E) SEQ ID NO: 454

EVQLVESGGGLVKPGGSLKLSCAASGYTFTSYVMHWVRQAPGKGLEWIGYINPYNDGTKYNEKFQGRVTI
SSDKSISTAYMELSSLRSEDTAMYYCARGTYYYGTRVFDYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYTCNVDHKP
SNTKVDKKVEPKSCDKTHTCPPCPAPELLRGPSVFLFPPKPKDTLMISRTPEVTCVVVDVSHEDPEVQFN
WYVDGVEVHNAKTKPREEQYNSTYRVVSVLTVLHQDWLNGKEYKCKVSNKARPAPIEKTISKAKGQPREP
QVYTLPPSQEEMTKNQVSLTCLVKGFYPSDIAVEWESSGQPENNYNTTPPMLDSDGSFFLYSKLEVDKSR
WQEGNVFSCSVMHEALHNHYTQKSLSLSPG

XENP12152 Heavy Chain HC-scFv (D401K) SEQ ID NO: 455

EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLERKSSDKTHTCPRCPAPELLRGPSVFLFPPK
PKDTLMISRTPEVTCVVVDVSHEDPEVKFKWYVDGVEVHNAKTKPREEQYNSTYRVVSVLTVLHQDWLNG
KEYKCKVSNKARPAPIEKTISKAKGQPREPQVYTLPPSREEMTKNQVSLTCLVKGFYPSDIAVEWESNGQ
PENNYKTTPPVLDSKGSFFLYSKLTVDKSRWQQGNVFSCSVMHEALHNHYTQKSLSLSPGK

Figure 16B

XENP12155 Heavy Chain HC-Fab (L368E) SEQ ID NO: 456

EVQLVESGGGLVKPGGSLKLSCAASGYTFTSYVMHWVRQAPGKGLEWIGYINPYNDGTKYNEKFQGRVTI
SSDKSISTAYMELSSLRSEDTAMYYCARGTYYYGTRVFDYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYTCNVDHKP
SNTKVDKKVEPKSCDKTHTCPPCPAPELLRGPSVFLFPPKPKDTLMISRTPEVTCVVVDVSHEDPEVQFN
WYVDGVEVHNAKTKPREEQYNSTYRVVSVLTVLHQDWLNGKEYKCKVSNKARPAPIEKTISKAKGQPREP
QVYTLPPSQEEMTKNQVSLTCEVKGFYPSDIAVEWESSGQPENNYNTTPPMLDSDGSFFLYSKLTVDKSR
WQEGNVFSCSVMHEALHNHYTQKSLSLSPG

XENP12155 Heavy Chain HC-scFv (S364K) SEQ ID NO: 457

EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLERKSSDKTHTCPRCPAPELLRGPSVFLFPPK
PKDTLMISRTPEVTCVVVDVSHEDPEVKFKWYVDGVEVHNAKTKPREEQYNSTYRVVSVLTVLHQDWLNG
KEYKCKVSNKARPAPIEKTISKAKGQPREPQVYTLPPSREEMTKNQVKLTCLVKGFYPSDIAVEWESNGQ
PENNYKTTPPVLDSDGSFFLYSKLTVDKSRWQQGNVFSCSVMHEALHNHYTQKSLSLSPGK

XENP11924, XENP12152, XENP12155 Light Chain SEQ ID NO: 458

DIVMTQSPATLSLSPGERATLSCRSSKSLQNVNGNTYLYWFQQKPGQSPQLLIYRMSNLNSGVPDRFSGS
GSGTEFTLTISSLEPEDFAVYYCMQHLEYPITFGAGTKLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLSSPV
TKSFNRGEC

Figure 19

| AMINO ACID | pI |
|---|---|
| Alanine Ala A | 6.00 |
| Arginine Arg R | 11.15 |
| Asparagine Asn N | 5.41 |
| Aspartic acid Asp D | 2.77 |
| Cysteine Cys C | 5.02 |
| Glutamic acid Glu E | 3.22 |
| Glutamine Gln Q | 5.65 |
| Glycine Gly G | 5.97 |
| Histidine His H | 7.47 |
| Isoleucine Ile I | 5.94 |
| Leucine Leu L | 5.98 |
| Lysine Lys K | 9.59 |
| Methionine Met M | 5.74 |
| Phenylalanine Phe F | 5.48 |
| Proline Pro P | 6.30 |
| Serine Ser S | 5.68 |
| Threonine Thr T | 5.64 |
| Tryptophan Trp W | 5.89 |
| Tyrosine Tyr Y | 5.66 |
| Valine Val V | 5.96 |

Figure 20A

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP0024547 | IgG1-WT | 2 | Ck-WT | 112 | 8.10 | 122 | 0 | 118 | 0 | 0 | 0 | 0 | 0 |
| XENP0028384 | IgG2-WT | 3 | Ck-WT | 113 | 7.31 | 118 | -4 | 118 | 2 | 6 | 27 | 0 | 27 |
| NA | IgG3-WT | 4 | Ck-WT | n/a | | | | | | | 22 | 0 | 22 |
| NA | IgG4-WT | 5 | Ck-WT | n/a | | | | | | | 28 | 0 | 28 |
| XENP0037349 | IgG1/2-HC | 6 | Ck-WT | 114 | 8.11 | 120 | -2 | 114 | -2 | 0 | 11 | 0 | 11 |
| XENP0035853 | IgG1-4345 | 50 | Ck-WT | 115 | 8.1 | 122 | 0 | 116 | 0 | 0 | 1 | 0 | 1 |
| XENP0028389 | IgG2-4345 | 51 | Ck-WT | 116 | 7.31 | 118 | -4 | 118 | 2 | 0 | 28 | 0 | 28 |
| XENP0029491 | IgG1-CH1-pI(6) | 7 | Ck-WT | 1 | 6.21 | 116 | -6 | 128 | 12 | -18 | 6 | 0 | 6 |
| XENP0029492 | IgG1-WT | 2 | Ck-pI(6) | 8 | 6.21 | 116 | -6 | 128 | 12 | -18 | 0 | 6 | 6 |
| XENP0030893 | IgG1-CH1-pI(6) | 192 | Ck-pI(6) | 117 | 5.49 | 110 | -12 | 140 | 24 | -30 | 6 | 6 | 12 |
| XENP0030894 | IgG1-CH1-pI(6)-4345 | 52 | Ck-pI(6) | 117 | 5.49 | 110 | -12 | 140 | 24 | -30 | 7 | 6 | 13 |
| XENP0030895 | IgG1-CH1-pI(6)-428L/4345 | 53 | Ck-pI(6) | 117 | 5.49 | 110 | -12 | 140 | 24 | -30 | 8 | 6 | 14 |
| XENP0102088 | IgG1-WT | 2 | Ck-pI(3) | 120 | 6.58 | 116 | -6 | 122 | 6 | 0 | 0 | 3 | 3 |
| XENP0102089 | IgG1-WT | 2 | Ck-pI(6-DEDE) | 121 | 5.85 | 116 | -6 | 136 | 20 | -20 | 0 | 10 | 10 |
| XENP0102090 | IgG3-WT | 3 | Ck-pI(3) | 122 | 6.16 | 112 | -10 | 124 | 8 | -12 | 27 | 3 | 30 |
| XENP0102091 | IgG3-WT | 3 | Ck-pI(6) | 123 | 5.98 | 112 | -10 | 130 | 14 | -18 | 27 | 6 | 33 |
| XENP0102092 | IgG2-WT | 3 | Ck-pI(6-DEDE) | 124 | 5.58 | 110 | -12 | 136 | 20 | -26 | 27 | 10 | 37 |
| XENP0102093 | pI-Iso1 | 13 | Ck-WT | 125 | 6.28 | 110 | -12 | 122 | 6 | -12 | 13 | 0 | 13 |
| XENP0102094 | pI-Iso1(MF) | 14 | Ck-WT | 126 | 6.28 | 110 | -12 | 122 | 6 | -12 | 15 | 0 | 15 |
| XENP0102095 | pI-Iso1(MF) | 15 | Ck-WT | 127 | 6.18 | 110 | -12 | 128 | 12 | -18 | 19 | 0 | 19 |
| XENP0102096 | pI-Iso1(MF-YE) | 15 | Ck-pI(3) | 128 | 5.63 | 104 | -18 | 128 | 12 | -24 | 19 | 3 | 22 |
| XENP0102131 | pI-Iso1(MF-YE) | 15 | Ck-pI(6) | 129 | 5.43 | 104 | -18 | 134 | 16 | -30 | 19 | 6 | 25 |
| XENP0102132 | pI-Iso1(MF-YE) | 15 | Ck-pI(6-DEDE) | 130 | 5.23 | 104 | -18 | 142 | 26 | -38 | 19 | 10 | 29 |
| XENP0102133 | pI-Iso1(MF-YE-DEDE) | 16 | Ck-WT | 131 | 5.79 | 110 | -12 | 130 | 14 | -20 | 22 | 0 | 22 |

Figure 20B

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP010104 | pI-Iso3(NF-YE-DEDE) | 16 | Ck-pI(3) | 132 | 5.37 | 104 | -18 | 138 | 20 | -32 | 22 | 3 | 25 |
| XENP010105 | pI-Iso3(NF-YE-DEDE) | 16 | Ck-pI(6) | 133 | 5.22 | 104 | -18 | 142 | 28 | -36 | 22 | 6 | 28 |
| XENP010106 | pI-Iso3(NF-YE-DEDE) | 16 | Ck-pI(6-DEDE) | 134 | 5.07 | 104 | -18 | 150 | 34 | -46 | 22 | 10 | 32 |
| XENP010107 | IgG1-pI(7) | 25 | Ck-pI(4) | 135 | 5.31 | 100 | -18 | 138 | 20 | -38 | 7 | 4 | 11 |
| XENP010108 | IgG1-pI(11) | 26 | Ck-pI(4) | 136 | 4.99 | 92 | -22 | 144 | 26 | -50 | 11 | 4 | 15 |
| XENP010109 | IgG1/2-pI(7) | 27 | Ck-pI(3) | 137 | 5.36 | 100 | -30 | 134 | 18 | -48 | 17 | 4 | 21 |
| XENP010110 | IgG1/2-pI(11) | 28 | Ck-pI(4) | 145 | 5.01 | 92 | -22 | 142 | 26 | -48 | 21 | 4 | 25 |
| XENP010217 | IgG1-pI(6)-Neutral-to-DE | 56 | Ck-K152D S156E S202E | 138 | 6.59 | 122 | 0 | 128 | 12 | -6 | 3 | 3 | 6 |
| XENP010218 | IgG1-pI(6)-KR-to-Neutral | 57 | Ck-K126Q K149Q K168Q | 139 | 6.58 | 110 | -12 | 116 | 0 | -6 | 3 | 3 | 6 |
| XENP010219 | IgG1-pI(6)-KR-to-DE | 58 | Ck-K126E K149E K168E | 140 | 5.92 | 110 | -12 | 128 | 12 | -18 | 3 | 3 | 6 |
| | IgG-pI-Iso2 | 19 | Ck-WT | 141 | 6.27 | 110 | -12 | 122 | 6 | -18 | 25 | 0 | 25 |
| | IgG-pI-Iso3 | 22 | Ck-WT | 142 | 6.20 | 110 | -12 | 122 | 6 | -18 | 19 | 0 | 19 |
| | IgG-pI-Iso2-434S | 62 | Ck-WT | 143 | 6.27 | 110 | -12 | 122 | 6 | -18 | 29 | 0 | 29 |
| | IgG-pI-Iso3-434S | 63 | Ck-WT | 144 | 6.20 | 110 | -12 | 122 | 6 | -18 | 20 | 0 | 20 |
| | IgG-pI-Iso2 | 19 | Ck-pI(4) | 145 | 5.55 | 102 | -20 | 128 | 12 | -26 | 28 | 4 | 32 |
| | IgG-pI-Iso3 | 22 | Ck-pI(4) | 145 | 5.54 | 102 | -20 | 130 | 14 | -28 | 19 | 4 | 23 |
| | IgG-pI-Iso2-434S | 62 | Ck-pI(3) | 145 | 5.55 | 102 | -20 | 128 | 12 | -26 | 29 | 4 | 33 |
| | IgG-pI-Iso3-434S | 63 | Ck-pI(4) | 145 | 5.54 | 102 | -20 | 130 | 14 | -28 | 20 | 4 | 24 |
| XENP010265 | IgG-pI-Iso3-222K | 70 | any light chain | 170 | 6.31 | 112 | -10 | 122 | 6 | -10 | 18 | 0 | 18 |
| XENP010266 | IgG-pI-Iso3-274K | 71 | any light chain | 171 | 6.31 | 112 | -10 | 122 | 6 | -10 | 18 | 0 | 18 |
| XENP010267 | IgG-pI-Iso3-296Y | 72 | any light chain | 172 | 6.20 | 110 | -12 | 122 | 6 | -12 | 18 | 0 | 18 |
| XENP010268 | IgG-pI-Iso3-300Y | 73 | any light chain | 173 | 6.20 | 110 | -12 | 122 | 6 | -12 | 18 | 0 | 18 |
| XENP010269 | IgG-pI-Iso3-309L | 74 | any light chain | 174 | 6.20 | 110 | -12 | 122 | 6 | -12 | 18 | 0 | 18 |

Figure 20C

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP010270 | IgG-pI-Iso3-339A | 75 | any light chain | 175 | 6.20 | 110 | -12 | 122 | 0 | -12 | 18 | 0 | 18 |
| XENP010271 | IgG-pI-Iso3-355Q | 76 | any light chain | 176 | 6.31 | 112 | -10 | 122 | 0 | -10 | 18 | 0 | 18 |
| XENP010272 | IgG-pI-Iso3-384N | 77 | any light chain | 177 | 6.20 | 110 | -12 | 122 | 0 | -12 | 18 | 0 | 18 |
| XENP010273 | IgG-pI-Iso3-392K | 78 | any light chain | 178 | 6.31 | 112 | -10 | 122 | 0 | -10 | 18 | 0 | 18 |
| XENP010274 | IgG-pI-Iso3-397V | 79 | any light chain | 179 | 6.20 | 110 | -12 | 122 | 0 | -12 | 18 | 0 | 18 |
| XENP010275 | IgG-pI-Iso3-419Q | 80 | any light chain | 180 | 6.31 | 110 | -12 | 122 | 4 | -10 | 18 | 0 | 18 |
| XENP010276 | IgG-pI-Iso3-208V/392Y | 81 | any light chain | 181 | 6.31 | 110 | -12 | 120 | 0 | -12 | 17 | 0 | 17 |
| XENP010277 | IgG-pI-Iso3-384N/392K/397V | 82 | any light chain | 182 | 6.20 | 110 | -10 | 122 | 0 | -10 | 16 | 0 | 16 |
| XENP010278 | IgG-pI-Iso3-137G | 83 | any light chain | 183 | 6.31 | 112 | -12 | 122 | 4 | -10 | 18 | 0 | 18 |
| XENP010279 | IgG-pI-Iso3-138G | 84 | any light chain | 184 | 6.31 | 110 | -12 | 120 | 0 | -12 | 18 | 0 | 18 |
| XENP010280 | IgG-pI-Iso3-192S | 85 | any light chain | 185 | 6.20 | 110 | -12 | 122 | 0 | -12 | 18 | 0 | 18 |
| XENP010281 | IgG-pI-Iso3-193L | 86 | any light chain | 186 | 6.20 | 110 | -12 | 122 | 0 | -12 | 18 | 0 | 18 |
| XENP010282 | IgG-pI-Iso3-199I | 87 | any light chain | 187 | 6.20 | 110 | -12 | 122 | 0 | -12 | 18 | 0 | 18 |
| XENP010283 | IgG-pI-Iso3-203N | 88 | any light chain | 188 | 6.20 | 110 | -12 | 120 | 4 | -10 | 18 | 0 | 18 |
| XENP010284 | IgG-pI-Iso3-214K | 89 | any light chain | 189 | 6.31 | 110 | -12 | 122 | 4 | -10 | 18 | 0 | 18 |
| XENP010285 | IgG-pI-Iso3-137G/138G | 90 | any light chain | 146 | 6.31 | 112 | -10 | 120 | 4 | -10 | 17 | 0 | 17 |
| XENP010286 |  | 23 | Ck-WT | 194 | 6.20 | 110 | -12 | 120 | 0 | -10 | 17 | 0 | 17 |
| XENP010287 | IgG-pI-Iso3-199I/203N | 91 | any light chain | 195 | 6.31 | 110 | -12 | 122 | 4 | -10 | 17 | 0 | 17 |
| XENP010288 | IgG-pI-Iso3-214K/222K | 92 | any light chain | 196 | 6.31 | 110 | -8 | 120 | 0 | -8 | 17 | 0 | 17 |
| XENP010289 | IgG-pI-Iso3-138G/192S/193L | 93 | any light chain | 197 | 6.44 | 114 | -12 | 122 | 0 | -12 | 16 | 0 | 16 |
| XENP010290 | IgG-PI-Iso3-137G/138G/192S/ | 94 | any light chain | 198 | 6.20 | 110 | -12 | 122 | 4 | -10 | 15 | 0 | 15 |

Figure 20D

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP010324 | IgG-pI-Iso3 | 22 | Ck-Iso(3) | 148 | 5.92 | 106 | -16 | 124 | 0 | -18 | 19 | 3 | 22 |
| XENP010325 | IgG-pI-Iso3 | 22 | Ck-Iso(4) | 149 | 5.83 | 104 | -18 | 124 | 0 | -20 | 19 | 4 | 23 |
| XENP010326 | IgG-pI-Iso3 | 22 | Ck-Iso(5) | 150 | 5.75 | 104 | -18 | 126 | 10 | -22 | 19 | 5 | 24 |
| XENP010327 | IgG-pI-Iso3 | 22 | Ck-Iso(6) | 151 | 5.69 | 104 | -18 | 128 | 12 | -24 | 19 | 6 | 25 |
|  | H2L0_IgG2_CH1_ gG3_CH2_CH3 | 95 | any light chain | 199 | 7.30 | 120 | -2 | 130 | 4 | 0 | 16 | 0 | 16 |
| XENP010425 | IgG-pI-Iso3-charges-only | 24 | Ck-WT | 193 |  |  |  |  |  |  |  |  |  |
| XENP010426 |  |  |  |  | 6.20 | 110 | -12 | 122 | 4 | -16 | 9 | 0 | 9 |
| XENP010427 | IgG-pI-Iso2-charges-only | 21 | Ck-WT | 192 | 6.37 | 110 | -12 | 120 | 4 | -10 | 18 | 0 | 18 |
|  | H2L0_IgG2_CH1_ gG1_Hinge_CH2_C | 161 | any light chain | 200 | 7.67 | 122 | 0 | 122 | 0 | 2 | 9 | 0 | 9 |
| XENP010428 | H3 | 98 | Ck-WT | 192 |  |  |  |  |  |  |  |  |  |
| XENP010429 | IgG-pI-Iso3-SL-4345 | 97 | Ck-WT | 192 | 6.20 | 110 | -12 | 120 | 0 | -12 | 18 | 0 | 18 |
| XENP010430 | IgG-pI-Iso3-SL-428L/4345 | | | | 6.20 | 110 | -12 | 122 | 6 | -12 | 19 | 0 | 19 |
|  | H2L0_pI_iso3_S13 8G/N192S/F193L_ N4345 | 162 | any light chain | 201 | 6.20 | 110 | -12 | 122 | 6 | -12 | 17 | 0 | 17 |
| XENP010468 |  |  |  |  |  |  |  |  |  |  |  |  |  |
| XENP010469 | H2L0_pI_iso3_E13 7G/S138G/N192S/F193L_N4345 | 163 | any light chain | 202 | 6.31 | 110 | -12 | 120 | 4 | -10 | 16 | 0 | 16 |
| XENP010470 | IgG-pI-Iso2-SL | 23 | Ck-WT | 192 | 6.27 | 110 | -12 | 120 | 4 | -10 | 26 | 0 | 26 |
| XENP010471 | IgG-pI-Iso2-SL-4345 | 98 | Ck-WT | 192 | 6.27 | 110 | -12 | 120 | 4 | -10 | 27 | 0 | 27 |

Figure 20E

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP210472 | IgG-pI-Iso3-charges-only-4345 | 191 | Ck-WT | 152 | 6.20 | 110 | -12 | 122 | 8 | -12 | 10 | 0 | 10 |
| XENP210473 | IgG-pI-Iso2-charges-only-4345 | 192 | Ck-WT | 152 | | | | | | | | | |
| | | | | | 6.27 | 110 | -12 | 120 | 4 | -10 | 19 | 0 | 19 |
| XENP210474 | HOLO_IgG2_CH1_I gG1_CH2_CH3_N4 345 | 164 | arry light chain | 203 | 7.30 | 120 | -2 | 120 | 4 | 0 | 17 | 0 | 17 |
| XENP210475 | HOLO_IgG2_CH1_I gG1_Hinge_CH2_C H3_N4345 | 165 | arry light chain | 204 | 7.67 | 122 | 0 | 120 | 4 | 2 | 10 | 0 | 10 |
| XENP210476 | IgG3_pI(7)-4345 | 25 | Ck-pI(4) | 135 | 5.31 | 100 | -22 | 126 | 20 | -26 | 8 | 4 | 12 |
| | | | Ck-pI(4) | 135 | 5.36 | 100 | -22 | 134 | 18 | -34 | 18 | 4 | 22 |
| XENP210477 | IgG1/2_pI(7)-4345 | 166 | IgG1/2_pI(7)-4345 | 205 | 6.27 | 100 | -12 | 120 | 4 | -10 | 23 | 0 | 23 |
| XENP210478 | HOLO_pI_iso1/2_c harges_only | 167 | arry light chain | 148 | 5.92 | 106 | -16 | 124 | 8 | -18 | 17 | 3 | 20 |
| XENP210511 | IgG-pI-Iso3-SL-4345 | 23 | Ck-Iso(3) | 149 | 5.83 | 104 | -18 | 124 | 8 | -20 | 17 | 4 | 21 |
| XENP210512 | IgG-pI-Iso3-SL-4345 | 23 | Ck-Iso(4) | 150 | 5.75 | 104 | -18 | 126 | 10 | -22 | 17 | 5 | 22 |
| XENP210513 | IgG-pI-Iso3-SL-4345 | 23 | Ck-Iso(5) | 149 | 5.92 | 106 | -16 | 124 | 8 | -18 | 18 | 3 | 21 |
| XENP210517 | IgG-pI-Iso3-SL-4345 | 98 | Ck-Iso(3) | 149 | 5.83 | 104 | -18 | | 8 | -20 | 18 | 4 | 22 |
| XENP210518 | IgG-pI-Iso3-SL-4345 | 98 | Ck-Iso(4) | 150 | 5.75 | 104 | -18 | 124 | 10 | -22 | 18 | 5 | 23 |
| XENP210519 | IgG-pI-Iso3-SL-4345 | 98 | Ck-Iso(5) | 150 | | | | 126 | | | | | |

Figure 20F

| XenP# | Name (HC) | SEQ ID NO (HC) | Name (LC) | SEQ ID NO (LC) | Calc. pI | # KR | Delta KR (vs. WT) | # DE | Delta DE (vs. WT) | Charge State | # HC Mutations vs IgG1 | # LC Mutations vs IgG1 | Total # of Mutations |
|---|---|---|---|---|---|---|---|---|---|---|---|---|---|
| XENP | IgG-pI-Isoa3-5L-428L/4345 | 97 | | | | | | | | | | | |
| XENP | IgG-pI-Isoa3-5L-428L/4345 | 97 | CK-Iso(3) | 148 | 5.92 | 106 | -18 | 124 | 8 | -18 | 19 | 3 | 22 |
| XENP | IgG-pI-Isoa3-5L-428L/4345 | 97 | CK-Iso(4) | 149 | 5.83 | 104 | -18 | 124 | 8 | -20 | 19 | 4 | 23 |
| XENP | IgG-pI-Isoa3-5L/4345 | 97 | CK-Iso(5) | 150 | 5.75 | 104 | -18 | 126 | 10 | -22 | 19 | 5 | 24 |
| XENP | IgG-pI-Isoa3-5L-4345 | 98 | CK-pI(4) | 149 | 5.54 | 102 | -20 | 130 | 14 | -30 | 18 | 4 | 22 |
| XENP | IgG-pI-Isoa3-4.4345 | 99 | CK-Iso(5) | 150 | 5.75 | 104 | -18 | 126 | 10 | -22 | 20 | 5 | 25 |
| XENP | IgG-pI-Isoa2-5L-4345 | 66 | CK-Iso(5) | 150 | 5.79 | 104 | -18 | 124 | 8 | -20 | 27 | 5 | 32 |

Figure 21A

| Variant | # of sub(s) | pI / pI | pI / WT | WT/ WT | avg delta pI |
|---|---|---|---|---|---|
| G137E/N203D/K274Q/R355Q/K392N/Q419E/K447_ | 7 | 6.43 | 7.14 | 8.02 | -0.79 |
| G137E/N203D/K274Q/R355Q/K392N/Q419E | 6 | 6.58 | 7.30 | 8.02 | -0.72 |
| G137E/N203D/K274Q/R355Q/K392N/K447_ | 6 | 6.58 | 7.30 | 8.02 | -0.72 |
| G137E/N203D/K274Q/R355Q/Q419E/K447_ | 6 | 6.58 | 7.30 | 8.02 | -0.72 |
| G137E/N203D/K274Q/K392N/Q419E/K447_ | 6 | 6.58 | 7.30 | 8.02 | -0.72 |
| G137E/N203D/R355Q/K392N/Q419E/K447_ | 6 | 6.58 | 7.30 | 8.02 | -0.72 |
| G137E/K274Q/R355Q/K392N/Q419E/K447_ | 6 | 6.58 | 7.30 | 8.02 | -0.72 |
| N203D/K274Q/R355Q/K392N/Q419E/K447_ | 6 | 6.58 | 7.30 | 8.02 | -0.72 |
| G137E/N203D/K274Q/R355Q/K392N | 5 | 6.76 | 7.46 | 8.02 | -0.63 |
| G137E/N203D/K274Q/R355Q/Q419E | 5 | 6.76 | 7.46 | 8.02 | -0.63 |
| G137E/N203D/K274Q/R355Q/K447_ | 5 | 6.76 | 7.46 | 8.02 | -0.63 |
| G137E/N203D/K274Q/K392N/Q419E | 5 | 6.76 | 7.46 | 8.02 | -0.63 |
| G137E/N203D/K274Q/K392N/K447_ | 5 | 6.76 | 7.46 | 8.02 | -0.63 |
| G137E/N203D/K274Q/Q419E/K447_ | 5 | 6.76 | 7.46 | 8.02 | -0.63 |
| G137E/N203D/R355Q/K392N/Q419E | 5 | 6.76 | 7.46 | 8.02 | -0.63 |
| G137E/N203D/R355Q/K392N/K447_ | 5 | 6.76 | 7.46 | 8.02 | -0.63 |
| G137E/N203D/R355Q/Q419E/K447_ | 5 | 6.76 | 7.46 | 8.02 | -0.63 |
| G137E/N203D/K392N/Q419E/K447_ | 5 | 6.76 | 7.46 | 8.02 | -0.63 |
| G137E/K274Q/R355Q/K392N/Q419E | 5 | 6.76 | 7.46 | 8.02 | -0.63 |
| G137E/K274Q/R355Q/K392N/K447_ | 5 | 6.76 | 7.46 | 8.02 | -0.63 |
| G137E/K274Q/R355Q/Q419E/K447_ | 5 | 6.76 | 7.46 | 8.02 | -0.63 |
| G137E/K274Q/K392N/Q419E/K447_ | 5 | 6.76 | 7.46 | 8.02 | -0.63 |
| G137E/R355Q/K392N/Q419E/K447_ | 5 | 6.76 | 7.46 | 8.02 | -0.63 |
| N203D/K274Q/R355Q/K392N/Q419E | 5 | 6.76 | 7.46 | 8.02 | -0.63 |
| N203D/K274Q/R355Q/K392N/K447_ | 5 | 6.76 | 7.46 | 8.02 | -0.63 |
| N203D/K274Q/R355Q/Q419E/K447_ | 5 | 6.76 | 7.46 | 8.02 | -0.63 |
| N203D/K274Q/K392N/Q419E/K447_ | 5 | 6.76 | 7.46 | 8.02 | -0.63 |
| N203D/R355Q/K392N/Q419E/K447_ | 5 | 6.76 | 7.46 | 8.02 | -0.63 |
| K274Q/R355Q/K392N/Q419E/K447_ | 5 | 6.76 | 7.46 | 8.02 | -0.63 |
| G137E/N203D/K274Q/R355Q | 4 | 7.00 | 7.61 | 8.02 | -0.51 |
| G137E/N203D/K274Q/K392N | 4 | 7.00 | 7.61 | 8.02 | -0.51 |
| G137E/N203D/K274Q/Q419E | 4 | 7.00 | 7.61 | 8.02 | -0.51 |
| G137E/N203D/K274Q/K447_ | 4 | 7.00 | 7.61 | 8.02 | -0.51 |
| G137E/N203D/R355Q/K392N | 4 | 7.00 | 7.61 | 8.02 | -0.51 |
| G137E/N203D/R355Q/Q419E | 4 | 7.00 | 7.61 | 8.02 | -0.51 |
| G137E/N203D/R355Q/K447_ | 4 | 7.00 | 7.61 | 8.02 | -0.51 |
| G137E/N203D/K392N/Q419E | 4 | 7.00 | 7.61 | 8.02 | -0.51 |
| G137E/N203D/K392N/K447_ | 4 | 7.00 | 7.61 | 8.02 | -0.51 |
| G137E/N203D/Q419E/K447_ | 4 | 7.00 | 7.61 | 8.02 | -0.51 |
| G137E/K274Q/R355Q/K392N | 4 | 7.00 | 7.61 | 8.02 | -0.51 |
| G137E/K274Q/R355Q/Q419E | 4 | 7.00 | 7.61 | 8.02 | -0.51 |
| G137E/K274Q/R355Q/K447_ | 4 | 7.00 | 7.61 | 8.02 | -0.51 |
| G137E/K274Q/K392N/Q419E | 4 | 7.00 | 7.61 | 8.02 | -0.51 |
| G137E/K274Q/K392N/K447_ | 4 | 7.00 | 7.61 | 8.02 | -0.51 |
| G137E/K274Q/Q419E/K447_ | 4 | 7.00 | 7.61 | 8.02 | -0.51 |
| G137E/R355Q/K392N/Q419E | 4 | 7.00 | 7.61 | 8.02 | -0.51 |
| G137E/R355Q/K392N/K447_ | 4 | 7.00 | 7.61 | 8.02 | -0.51 |
| G137E/R355Q/Q419E/K447_ | 4 | 7.00 | 7.61 | 8.02 | -0.51 |
| G137E/K392N/Q419E/K447_ | 4 | 7.00 | 7.61 | 8.02 | -0.51 |
| N203D/K274Q/R355Q/K392N | 4 | 7.00 | 7.61 | 8.02 | -0.51 |
| N203D/K274Q/R355Q/Q419E | 4 | 7.00 | 7.61 | 8.02 | -0.51 |
| N203D/K274Q/R355Q/K447_ | 4 | 7.00 | 7.61 | 8.02 | -0.51 |
| N203D/K274Q/K392N/Q419E | 4 | 7.00 | 7.61 | 8.02 | -0.51 |

Figure 21B

| | | | | | |
|---|---|---|---|---|---|
| N203D/K274Q/K392N/K447_ | | 4 | 7.00 | 7.61 | 8.02 | -0.51 |
| N203D/K274Q/Q419E/K447_ | | 4 | 7.00 | 7.61 | 8.02 | -0.51 |
| N203D/R355Q/K392N/Q419E | | 4 | 7.00 | 7.61 | 8.02 | -0.51 |
| N203D/R355Q/K392N/K447_ | | 4 | 7.00 | 7.61 | 8.02 | -0.51 |
| N203D/R355Q/Q419E/K447_ | | 4 | 7.00 | 7.61 | 8.02 | -0.51 |
| N203D/K392N/Q419E/K447_ | | 4 | 7.00 | 7.61 | 8.02 | -0.51 |
| K274Q/R355Q/K392N/Q419E | | 4 | 7.00 | 7.61 | 8.02 | -0.51 |
| K274Q/R355Q/K392N/K447_ | | 4 | 7.00 | 7.61 | 8.02 | -0.51 |
| K274Q/R355Q/Q419E/K447_ | | 4 | 7.00 | 7.61 | 8.02 | -0.51 |
| K274Q/K392N/Q419E/K447_ | | 4 | 7.00 | 7.61 | 8.02 | -0.51 |
| R355Q/K392N/Q419E/K447_ | | 4 | 7.00 | 7.61 | 8.02 | -0.51 |
| G137E/N203D/K274Q | | 3 | 7.30 | 7.74 | 8.02 | -0.36 |
| G137E/N203D/R355Q | | 3 | 7.30 | 7.74 | 8.02 | -0.36 |
| G137E/N203D/K392N | | 3 | 7.30 | 7.74 | 8.02 | -0.36 |
| G137E/N203D/Q419E | | 3 | 7.30 | 7.74 | 8.02 | -0.36 |
| G137E/N203D/K447_ | | 3 | 7.30 | 7.74 | 8.02 | -0.36 |
| G137E/K274Q/R355Q | | 3 | 7.30 | 7.74 | 8.02 | -0.36 |
| G137E/K274Q/K392N | | 3 | 7.30 | 7.74 | 8.02 | -0.36 |
| G137E/K274Q/Q419E | | 3 | 7.30 | 7.74 | 8.02 | -0.36 |
| G137E/K274Q/K447_ | | 3 | 7.30 | 7.74 | 8.02 | -0.36 |
| G137E/R355Q/K392N | | 3 | 7.30 | 7.74 | 8.02 | -0.36 |
| G137E/R355Q/Q419E | | 3 | 7.30 | 7.74 | 8.02 | -0.36 |
| G137E/R355Q/K447_ | | 3 | 7.30 | 7.74 | 8.02 | -0.36 |
| G137E/K392N/Q419E | | 3 | 7.30 | 7.74 | 8.02 | -0.36 |
| G137E/K392N/K447_ | | 3 | 7.30 | 7.74 | 8.02 | -0.36 |
| G137E/Q419E/K447_ | | 3 | 7.30 | 7.74 | 8.02 | -0.36 |
| N203D/K274Q/R355Q | | 3 | 7.30 | 7.74 | 8.02 | -0.36 |
| N203D/K274Q/K392N | | 3 | 7.30 | 7.74 | 8.02 | -0.36 |
| N203D/K274Q/Q419E | | 3 | 7.30 | 7.74 | 8.02 | -0.36 |
| N203D/K274Q/K447_ | | 3 | 7.30 | 7.74 | 8.02 | -0.36 |
| N203D/R355Q/K392N | | 3 | 7.30 | 7.74 | 8.02 | -0.36 |
| N203D/R355Q/Q419E | | 3 | 7.30 | 7.74 | 8.02 | -0.36 |
| N203D/R355Q/K447_ | | 3 | 7.30 | 7.74 | 8.02 | -0.36 |
| N203D/K392N/Q419E | | 3 | 7.30 | 7.74 | 8.02 | -0.36 |
| N203D/K392N/K447_ | | 3 | 7.30 | 7.74 | 8.02 | -0.36 |
| N203D/Q419E/K447_ | | 3 | 7.30 | 7.74 | 8.02 | -0.36 |
| K274Q/R355Q/K392N | | 3 | 7.30 | 7.74 | 8.02 | -0.36 |
| K274Q/R355Q/Q419E | | 3 | 7.30 | 7.74 | 8.02 | -0.36 |
| K274Q/R355Q/K447_ | | 3 | 7.30 | 7.74 | 8.02 | -0.36 |
| K274Q/K392N/Q419E | | 3 | 7.30 | 7.74 | 8.02 | -0.36 |
| K274Q/K392N/K447_ | | 3 | 7.30 | 7.74 | 8.02 | -0.36 |
| K274Q/Q419E/K447_ | | 3 | 7.30 | 7.74 | 8.02 | -0.36 |
| R355Q/K392N/Q419E | | 3 | 7.30 | 7.74 | 8.02 | -0.36 |
| R355Q/K392N/K447_ | | 3 | 7.30 | 7.74 | 8.02 | -0.36 |
| R355Q/Q419E/K447_ | | 3 | 7.30 | 7.74 | 8.02 | -0.36 |
| K392N/Q419E/K447_ | | 3 | 7.30 | 7.74 | 8.02 | -0.36 |
| G137E/N203D | | 2 | 7.61 | 7.85 | 8.02 | -0.21 |
| G137E/K274Q | | 2 | 7.61 | 7.85 | 8.02 | -0.21 |
| G137E/R355Q | | 2 | 7.61 | 7.85 | 8.02 | -0.21 |
| G137E/K392N | | 2 | 7.61 | 7.85 | 8.02 | -0.21 |
| G137E/Q419E | | 2 | 7.61 | 7.85 | 8.02 | -0.21 |
| G137E/K447_ | | 2 | 7.61 | 7.85 | 8.02 | -0.21 |
| N203D/K274Q | | 2 | 7.61 | 7.85 | 8.02 | -0.21 |
| N203D/R355Q | | 2 | 7.61 | 7.85 | 8.02 | -0.21 |
| N203D/K392N | | 2 | 7.61 | 7.85 | 8.02 | -0.21 |
| N203D/Q419E | | 2 | 7.61 | 7.85 | 8.02 | -0.21 |
| N203D/K447_ | | 2 | 7.61 | 7.85 | 8.02 | -0.21 |

Figure 21C

| | | | | | |
|---|---|---|---|---|---|
| K274Q/R355Q | | 2 | 7.61 | 7.85 | 8.02 | -0.21 |
| K274Q/K392N | | 2 | 7.61 | 7.85 | 8.02 | -0.21 |
| K274Q/Q419E | | 2 | 7.61 | 7.85 | 8.02 | -0.21 |
| K274Q/K447_ | | 2 | 7.61 | 7.85 | 8.02 | -0.21 |
| R355Q/K392N | | 2 | 7.61 | 7.85 | 8.02 | -0.21 |
| R355Q/Q419E | | 2 | 7.61 | 7.85 | 8.02 | -0.21 |
| R355Q/K447_ | | 2 | 7.61 | 7.85 | 8.02 | -0.21 |
| K392N/Q419E | | 2 | 7.61 | 7.85 | 8.02 | -0.21 |
| K392N/K447_ | | 2 | 7.61 | 7.85 | 8.02 | -0.21 |
| Q419E/K447_ | | 2 | 7.61 | 7.85 | 8.02 | -0.21 |
| G137E | | 1 | 7.85 | 7.94 | 8.02 | -0.09 |
| N203D | | 1 | 7.85 | 7.94 | 8.02 | -0.09 |
| K274Q | | 1 | 7.85 | 7.94 | 8.02 | -0.09 |
| R355Q | | 1 | 7.85 | 7.94 | 8.02 | -0.09 |
| K392N | | 1 | 7.85 | 7.94 | 8.02 | -0.09 |
| Q419E | | 1 | 7.85 | 7.94 | 8.02 | -0.09 |
| K447_ | | 1 | 7.85 | 7.94 | 8.02 | -0.09 |

Figure 22

| Variant | # of sub(s) | pI / pI | pI / WT | WT/ WT | avg delta pI |
|---|---|---|---|---|---|
| Q196K/P217R/P228R/N276K/H435R | 5 | 8.53 | 8.32 | 8.02 | 0.25 |
| Q196K/P217R/P228R/N276K | 4 | 8.45 | 8.27 | 8.02 | 0.22 |
| Q196K/P217R/P228R/H435R | 4 | 8.46 | 8.28 | 8.02 | 0.22 |
| Q196K/P217R/N276K/H435R | 4 | 8.45 | 8.27 | 8.02 | 0.22 |
| Q196K/P228R/N276K/H435R | 4 | 8.45 | 8.27 | 8.02 | 0.22 |
| P217R/P228R/N276K/H435R | 4 | 8.46 | 8.28 | 8.02 | 0.22 |
| Q196K/P217R/P228R | 3 | 8.37 | 8.22 | 8.02 | 0.17 |
| Q196K/P217R/N276K | 3 | 8.37 | 8.22 | 8.02 | 0.17 |
| Q196K/P217R/H435R | 3 | 8.37 | 8.22 | 8.02 | 0.17 |
| Q196K/P228R/N276K | 3 | 8.37 | 8.22 | 8.02 | 0.17 |
| Q196K/P228R/H435R | 3 | 8.37 | 8.22 | 8.02 | 0.17 |
| Q196K/N276K/H435R | 3 | 8.37 | 8.22 | 8.02 | 0.17 |
| P217R/P228R/N276K | 3 | 8.37 | 8.22 | 8.02 | 0.17 |
| P217R/P228R/H435R | 3 | 8.37 | 8.22 | 8.02 | 0.18 |
| P217R/N276K/H435R | 3 | 8.37 | 8.22 | 8.02 | 0.17 |
| P228R/N276K/H435R | 3 | 8.37 | 8.22 | 8.02 | 0.17 |
| Q196K/P217R | 2 | 8.27 | 8.16 | 8.02 | 0.13 |
| Q196K/P228R | 2 | 8.27 | 8.16 | 8.02 | 0.13 |
| Q196K/N276K | 2 | 8.27 | 8.16 | 8.02 | 0.13 |
| Q196K/H435R | 2 | 8.27 | 8.16 | 8.02 | 0.13 |
| P217R/P228R | 2 | 8.28 | 8.16 | 8.02 | 0.13 |
| P217R/N276K | 2 | 8.27 | 8.16 | 8.02 | 0.13 |
| P217R/H435R | 2 | 8.28 | 8.16 | 8.02 | 0.13 |
| P228R/N276K | 2 | 8.27 | 8.16 | 8.02 | 0.13 |
| P228R/H435R | 2 | 8.28 | 8.16 | 8.02 | 0.13 |
| N276K/H435R | 2 | 8.27 | 8.16 | 8.02 | 0.13 |
| Q196K | 1 | 8.16 | 8.10 | 8.02 | 0.07 |
| P217R | 1 | 8.16 | 8.10 | 8.02 | 0.07 |
| P228R | 1 | 8.16 | 8.10 | 8.02 | 0.07 |
| N276K | 1 | 8.16 | 8.10 | 8.02 | 0.07 |
| H435R | 1 | 8.16 | 8.10 | 8.02 | 0.07 |

Figure 23A

HETERODIMERIZATION VARIANTS

|  | IgG1 | IgG2 | IgG3 | IgG4 | Variants |
|---|---|---|---|---|---|
| 196 | Q | Q | Q | K | K |
| 199 | I | T | T | T | T |
| 203 | N | D | N | D | D |
| 217 | P | R | L | S | R |
| 220 | C | C | P | G | E,R (IgG2) |
| 221 | D | – | LGD | – | E,R (IgG1) |
| 222 | K | V | T | – | E,R (IgG2) |
| 223 | T | – | T | – | D,E,R,K |
| 225 | T | – | T | P | D,E,R,K |
| 228 | P | P | RCPEPK SCDTPP PCPRCP EPKSCD TPPPCP RCPEPK SCDTPP PCPR | S | D,E,R,K |
| 247 | P | P | P | P | Q |
| 276 | N | N | K | N | K |
| 340 | K | K | K | K | E,Q |
| 345 | E | E | E | E | K |
|  | Q | Q | Q | Q | E,K,R |
| 349 | Y | Y | Y | Y | A,C,D,E,I,K,S,T,W |
| 350 | T | T | T | T | I |
| 351 | L | L | L | L | E,K,V,Y |
| 354 | S | S | S | S | C |
| 355 | R | R | R | Q | E,Q |
| 356 | D | E | E | E | K, L, R |
| 357 | E | E | E | E | K,R,Q,T |
|  | K | K | K | K | D,E |
| 362 | Q | Q | Q | Q | E,K |
|  | S | S | S | S | C,D,E,F,G,H,K,R,T,Y |
| 366 | T | T | T | T | A,D,I,K,L,M,S,V,W,Y |
|  | L | L | L | L | A,D,E,K,S all but C,P |
| 370 | K | K | K | K | C,D,E,G,R,S,T,V all but C,P |
| 371 | G | G | G | G | D |
| 384 | N | N | S | N | S |
| 390 | N | N | N | N | D,E,K,R |
| 392 | K | K | N | K | C,D,E,F,L,M,N |
| 394 | T | T | T | T | F,S,V,W,Y |

Figure 23B

|     | IgG1 | IgG2 | IgG3 | IgG4 | Variants |
|-----|------|------|------|------|----------|
| 395 | P | P | P | P | T,V |
| 396 | P | P | P | P | T,V |
| 397 | V | M | M | V | M,S,T |
| 399 | D | D | D | D | all but C,P<br>C,K,R |
| 400 | S | S | S | S | A,D,E,K,R |
| 401 | D | D | D | D | K,N,R |
| 405 | F | F | F | F | L, all but C,P<br>A,F,L,M,S,T,V |
| 407 | Y | Y | Y | Y | T,V<br>all but C,P<br>A,L,M,V |
| 409 | K | K | K | R | R<br>,all but C,P<br>D,E,F,K,L,M,V,W |
|     | T | T | T | T | D,E,K,L,N,R,S |
| 419 | Q | Q | Q | E | E |
| 439 | K | K | K | K | D,E |

FIGURE 24

COMBINATIONS OF VARIANTS INTO HETERODIMERIZATION FORMATS

| Heterodimerization format | FcRn variants Monomer 1 and/or Monomer 2 | Fc variants Monomer 1 and/or Monomer 2 | pI variants | Steric variants (including charge pairs) | Combinations (See Legend E) |
|---|---|---|---|---|---|
| "bottle opener" scFv-Fab-Fc (Figure 1B) | See Legend A | See Legend B | See Legend C | See Legend D | 1), 2), 3), 4), 5),6), 7), 8), 9) and 10) |
| Trimeric bottle opener (Figure 5A) | See Legend A | See Legend B | See Legend C | See Legend D | 1), 2), 3), 4), 5),6), 7), 8), 9) and 10) |
| Trimeric bottle opener (scFv-Fab-Fv-scFv; Figure 5A) | See Legend A | See Legend B | See Legend C | See Legend D | 1), 2), 3), 4), 5),6), 7), 8), 9) and 10) |
| Trimeric bottle opener (scFv-Fab-Fv-scFv; Figure 5B) | See Legend A | See Legend B | See Legend C | See Legend D | 1), 2), 3), 4), 5),6), 7), 8), 9) and 10) |
| Trimeric bottle opener (scFv-Fab-Fv-scFv; Figure 5C) | See Legend A | See Legend B | See Legend C | See Legend D | 1), 2), 3), 4), 5),6), 7), 8), 9) and 10) |
| Trimeric bottle opener (scFv-Fab-Fv-Fab; Figure 5D) | See Legend A | See Legend B | See Legend C | See Legend D | 1), 2), 3), 4), 5),6), 7), 8), 9) and 10) |
| Trimeric bottle opener (scFv-Fab-Fv-Fab; Figure 5E) | See Legend A | See Legend B | See Legend C | See Legend D | 1), 2), 3), 4), 5),6), 7), 8), 9) and 10) |

Figure 25A

| XENP | VH ID | VL ID | VH Substitutions | VL Substitutions |
|---|---|---|---|---|
| 11502 | H1 | L1.4 | | |
| 11794 | H1.3 | L1.4 | L11D | |
| 11795 | H1.4 | L1.4 | L11K | |
| 11796 | H1.5 | L1.4 | L11N | |
| 11801 | H1.6 | L1.4 | L11S | |
| 11802 | H1.7 | L1.4 | R19K | |
| 11803 | H1.8 | L1.4 | N30S | |
| 11804 | H1.9 | L1.4 | N35H | |
| 11805 | H1.10 | L1.4 | N35S | |
| 11806 | H1.11 | L1.4 | P41S | |
| 11807 | H1.12 | L1.4 | Y52CA | |
| 11808 | H1.13 | L1.4 | Y52CA/N54S | |
| 11809 | H1.14 | L1.4 | Y58A | |
| 11810 | H1.15 | L1.4 | D61A | |
| 11811 | H1.16 | L1.4 | D73N | |
| 11812 | H1.17 | L1.4 | D73T | |
| 11813 | H1.18 | L1.4 | L78A | |
| 11814 | H1.19 | L1.4 | A84D | |
| 11815 | H1.20 | L1.4 | A84K | |
| 11816 | H1.21 | L1.4 | A84S | |
| 11817 | H1.22 | L1.4 | V93A | |
| 11818 | H1.23 | L1.4 | V93T | |
| 11819 | H1.24 | L1.4 | N100D | |
| 11820 | H1.25 | L1.4 | N100Q | |
| 11821 | H1.26 | L1.4 | S100AT | |
| 11822 | H1.27 | L1.4 | A101D | |
| 11823 | H1.28 | L1.4 | L108T | |
| 11824 | H1.29 | L1.30 | G44S | G100S |
| 11825 | H1 | L1.10 | | E7P |
| 11826 | H1 | L1.11 | | T12S |
| 11827 | H1 | L1.12 | | G17A |
| 11828 | H1 | L1.13 | | G17Q |
| 11829 | H1 | L1.14 | | T29S |
| 11830 | H1 | L1.15 | | T29S/S30G/N31H |
| 11831 | H1 | L1.16 | | G49Y/G50D |
| 11832 | H1 | L1.17 | | K53N |
| 11833 | H1 | L1.18 | | P56S |
| 11834 | H1 | L1.19 | | N52S/K53N/R54K/A55H/P56S/G57W/V58T |
| 11835 | H1 | L1.20 | | A60D |
| 11836 | H1 | L1.21 | | L66K/L67S |
| 11837 | H1 | L1.22 | | L66S/L67S |

Figure 25B

| XENP | VH ID | VL ID | VH Substitutions | VL Substitutions |
|---|---|---|---|---|
| 11838 | H1 | L1.23 | | L75I |
| 11839 | H1 | L1.24 | | P80A |
| 11840 | H1 | L1.25 | | P80S |
| 11841 | H1 | L1.26 | | E85D |
| 11842 | H1 | L1.27 | | A89L |
| 11843 | H1 | L1.28 | | L95H |
| 11844 | H1 | L1.29 | | T105E/V106I/L106AK |
| 11920 | H1 | L3.1 | | |
| 11921 | H1 | L5.1 | | |
| 11922 | H1 | L1.31 | | L75D/E85D/L95H |
| 11923 | H1 | L1.32 | | Q38E |
| 12107 | H1.38 | L1.4 | V89T | |
| 12108 | H1 | L1.33 | | Q42K |
| 12109 | H1 | L1.34 | | Q42T |
| 12110 | H1 | L1.35 | | Q42S/A43P |
| 12111 | H1 | L1.36 | | A43P |
| 12112 | H1 | L1.37 | | A43G |
| 12113 | H1 | L1.38 | | A43S |
| 12114 | H1 | L1.39 | | A43D |
| 12131 | H1.30 | L1.4 | N30S/N100D | |
| 12132 | H1.31 | L1.4 | N30S/N35S/N100D | |
| 12133 | H1.32 | L1.4 | N30S/Y52CA/N100D | |
| 12134 | H1.33 | L1.4 | N30S/N100D/A101D | |
| 12135 | H1.34 | L1.4 | N30S/N35S/Y52CA/N100D/A101D | |
| 12136 | H1.35 | L1.4 | G10E/L11V/V12K/Q13K/G16E | |
| 12137 | H1.36 | L1.4 | K52BN/Y52C_/N53_/N54G/Y55G/A56S | |
| 12138 | H1.37 | L1.4 | Q39K | |
| 12139 | H1.37 | L1.32 | Q39K | Q38E |
| 12149 | H1 | L1.40 | | L75I/E85D/L95H |
| 12213 | H1.30 | L1.40 | N30S/N100D | L75I/E85D/L95H |
| 12214 | H1.8 | L1.40 | N30S | L75I/E85D/L95H |
| 12215 | H1.39 | L1.40 | N30S/Q39K | L75I/E85D/L95H |
| 12216 | H1.40 | L1.40 | N30S/Q39K/N100D | L75I/E85D/L95H |
| 12217 | H1.30 | L1.41 | N30S/N100D | L75I/L95H |
| 12218 | H1.8 | L1.41 | N30S | L75I/L95H |
| 12219 | H1.39 | L1.41 | N30S/Q39K | L75I/L95H |
| 12220 | H1.40 | L1.41 | N30S/Q39K/N100D | L75I/L95H |

Figure 25C

| XENP | VH ID | VL ID | VH Substitutions | VL Substitutions |
|---|---|---|---|---|
| 12221 | H1.30 | L1.42 | N30S/N100D | L75I/Q42K/L95H |
| 12222 | H1.8 | L1.42 | N30S | L75I/Q42K/L95H |
| 12223 | H1.39 | L1.42 | N30S/Q39K | L75I/Q42K/L95H |
| 12224 | H1.40 | L1.42 | N30S/Q39K/N100D | L75I/Q42K/L95H |
| 12225 | H1.30 | L1.43 | N30S/N100D | L75I/A43S/L95H |
| 12226 | H1.8 | L1.43 | N30S | L75I/A43S/L95H |
| 12227 | H1.39 | L1.43 | N30S/Q39K | L75I/A43S/L95H |
| 12228 | H1.40 | L1.43 | N30S/Q39K/N100D | L75I/A43S/L95H |
| 12229 | H1.30 | L1.44 | N30S/N100D | L75I/Q42K/A43S/L95H |
| 12230 | H1.8 | L1.44 | N30S | L75I/Q42K/A43S/L95H |
| 12231 | H1.39 | L1.44 | N30S/Q39K | L75I/Q42K/A43S/L95H |
| 12232 | H1.40 | L1.44 | N30S/Q39K/N100D | L75I/Q42K/A43S/L95H |
| 12233 | H1.30 | L1.45 | N30S/N100D | L75I/Q42K/E85D/L95H |
| 12234 | H1.8 | L1.45 | N30S | L75I/Q42K/E85D/L95H |
| 12235 | H1.39 | L1.45 | N30S/Q39K | L75I/Q42K/E85D/L95H |
| 12236 | H1.40 | L1.45 | N30S/Q39K/N100D | L75I/Q42K/E85D/L95H |
| 12237 | H1.30 | L1.46 | N30S/N100D | L75I/A43S/E85D/L95H |
| 12238 | H1.8 | L1.46 | N30S | L75I/A43S/E85D/L95H |
| 12239 | H1.39 | L1.46 | N30S/Q39K | L75I/A43S/E85D/L95H |
| 12240 | H1.40 | L1.46 | N30S/Q39K/N100D | L75I/A43S/E85D/L95H |
| 12241 | H1.30 | L1.47 | N30S/N100D | L75I/Q42K/A43S/E85D/L95H |
| 12242 | H1.8 | L1.47 | N30S | L75I/Q42K/A43S/E85D/L95H |
| 12243 | H1.39 | L1.47 | N30S/Q39K | L75I/Q42K/A43S/E85D/L95H |
| 12244 | H1.40 | L1.47 | N30S/Q39K/N100D | L75I/Q42K/A43S/E85D/L95H |

Figure 26A

Humanized anti-CD3 heavy chain variable region
SEQ ID NO. 1.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS Humanized anti-CD3 light chain variable region
SEQ ID NO. 2.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11502 H1_L1.4

SEQ ID NO. 3.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 4.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 5.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 6.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11794 H1.3_L1.4

SEQ ID NO. 7.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 8.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26B

SEQ ID NO. 9.
EVQLVESGGGDVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 10.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11795 H1.4_L1.4

SEQ ID NO. 11.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 12.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 13.
EVQLVESGGGKVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 14.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11796 H1.5_L1.4
SEQ ID NO. 15.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

XENP11796 H1.5_L1.4, cont.
SEQ ID NO. 16.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 17.
EVQLVESGGGNVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

Figure 26C

SEQ ID NO. 18.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11801 H1.6_L1.4
SEQ ID NO. 19.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 20.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 21.
EVQLVESGGGSVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 22.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11802 H1.7_L1.4
SEQ ID NO. 23.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 24.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 25.
EVQLVESGGGLVQPGGSLKLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 26.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26D

XENP11803 H1.8_L1.4

SEQ ID NO. 27.
EVQLVESGGGLVQPGGSLRLSCAASGFTFS<u>TYAMN</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVLGSHHHHHH

SEQ ID NO. 28.
EVQLVESGGGLVQPGGSLRLSCAASGFTFS<u>TYAMN</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVL

SEQ ID NO. 29.
EVQLVESGGGLVQPGGSLRLSCAASGFTFS<u>TYAMN</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSS

SEQ ID NO. 30.
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVL

XENP11804 H1.9_L1.4

SEQ ID NO. 31.
EVQLVESGGGLVQPGGSLRLSCAASGFTFN<u>TYAMH</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVLGSHHHHHH

SEQ ID NO. 32.
EVQLVESGGGLVQPGGSLRLSCAASGFTFN<u>TYAMH</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVL

SEQ ID NO. 33.
EVQLVESGGGLVQPGGSLRLSCAASGFTFN<u>TYAMH</u>WVRQAPGKGLEWVG<u>RIRSKYNNYATYYADSVKGR</u>F
TISRDDSKNTLYLQMNSLRAEDTAVYYCVR<u>HGNFGNSYVSWFAY</u>WGQGTLVTVSS

SEQ ID NO. 34.
QAVVTQEPSLTVSPGGTVTLTC<u>GSSTGAVTTSNYAN</u>WVQQKPGQAPRGLI<u>GGTNKRAP</u>GVPARFSGSLLG
GKAALTLSGAQPEDEAEYYC<u>ALWYSNLWV</u>FGGGTKLTVL

Figure 26E

XENP11805 H1.10_L1.4

SEQ ID NO. 35.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 36.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 37.
EVQLVESGGGLVQPGGSLRLSCAASGFTFNTYAMSWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 38.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11806 H1.11_L1.4

SEQ ID NO. 39.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 40.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 41.
EVQLVESGGGLVQPGGSLRLSCAASGFTFNTYAMNWVRQASGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 42.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26F

XENP11807 H1.12_L1.4

SEQ ID NO. 43.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 44.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 45.
EVQLVESGGGLVQPGGSLRLSCAASGFTFNTYAMNWVRQAPGKGLEWVGRIRSKANNYATYYADSVKGRF
TISRDDSKNTLYLQMNSLRAEDTAVYYCVRHGNFGNSYVSWFAYWGQGTLVTVSS

SEQ ID NO. 46.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11808 H1.13_L1.4

SEQ ID NO. 47.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 48.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 49.
EVQLVESGGGLVQPGGSLRLSCAASGFTFNTYAMNWVRQAPGKGLEWVGRIRSKANSYATYYADSVKGRF
TISRDDSKNTLYLQMNSLRAEDTAVYYCVRHGNFGNSYVSWFAYWGQGTLVTVSS

SEQ ID NO. 50.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26G

XENP11809 H1.14_L1.4

SEQ ID NO. 51.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 52.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 53.
EVQLVESGGGLVQPGGSLRLSCAASGFTFNTYAMNWVRQAPGKGLEWVGRIRSKYNNYATAYADSVKGRF
TISRDDSKNTLYLQMNSLRAEDTAVYYCVRHGNFGNSYVSWFAYWGQGTLVTVSS

SEQ ID NO. 54.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11810 H1.15_L1.4

SEQ ID NO. 55.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 56.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 57.
EVQLVESGGGLVQPGGSLRLSCAASGFTFNTYAMNWVRQAPGKGLEWVGRIRSKYNNYATYYAASVKGRF
TISRDDSKNTLYLQMNSLRAEDTAVYYCVRHGNFGNSYVSWFAYWGQGTLVTVSS

SEQ ID NO. 58.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26H

XENP11811 H1.16_L1.4

SEQ ID NO. 59.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 60.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 61.
EVQLVESGGGLVQPGGSLRLSCAASGFTFNTYAMNWVRQAPGKGLEWVGRIRSKYNNYATYYADSVKGRF
TISRDNSKNTLYLQMNSLRAEDTAVYYCVRHGNFGNSYVSWFAYWGQGTLVTVSS

SEQ ID NO. 62.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11812 H1.17_L1.4

SEQ ID NO. 63.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 64.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 65.
EVQLVESGGGLVQPGGSLRLSCAASGFTFNTYAMNWVRQAPGKGLEWVGRIRSKYNNYATYYADSVKGRF
TISRDTSKNTLYLQMNSLRAEDTAVYYCVRHGNFGNSYVSWFAYWGQGTLVTV

SEQ ID NO. 66.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26I

XENP11813 H1.18_L1.4

SEQ ID NO. 67.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 68.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 69.
EVQLVESGGGLVQPGGSLRLSCAASGFTFNTYAMNWVRQAPGKGLEWVGRIRSKYNNYATYYADSVKGRF
TISRDDSKNTAYLQMNSLRAEDTAVYYCVRHGNFGNSYVSWFAYWGQGTLVTVSS

SEQ ID NO. 70.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11814 H1.19_L1.4

SEQ ID NO. 71.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 72.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 73.
EVQLVESGGGLVQPGGSLRLSCAASGFTFNTYAMNWVRQAPGKGLEWVGRIRSKYNNYATYYADSVKGRF
TISRDDSKNTLYLQMNSLRDEDTAVYYCVRHGNFGNSYVSWFAYWGQGTLVTVSS

SEQ ID NO. 74.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26J

XENP11815 H1.20_L1.4

SEQ ID NO. 75.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 76.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 77.
EVQLVESGGGLVQPGGSLRLSCAASGFTFNTYAMNWVRQAPGKGLEWVGRIRSKYNNYATYYADSVKGRF
TISRDDSKNTLYLQMNSLRKEDTAVYYCVRHGNFGNSYVSWFAYWGQGTLVTVSS

SEQ ID NO. 78.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11816 H1.21_L1.4

SEQ ID NO. 79.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 80.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 81.
EVQLVESGGGLVQPGGSLRLSCAASGFTFNTYAMNWVRQAPGKGLEWVGRIRSKYNNYATYYADSVKGRF
TISRDDSKNTLYLQMNSLRSEDTAVYYCVRHGNFGNSYVSWFAYWGQGTLVTVSS

SEQ ID NO. 82.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26K

XENP11817 H1.22_L1.4

SEQ ID NO. 83.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 84.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 85.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCARHGNFGNSYVSWFAYWGQGTLVTVSS

SEQ ID NO. 86.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11818 H1.23_L1.4

SEQ ID NO. 87.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 88.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 89.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCTRHGNFGNSYVSWFAYWGQGTLVTVSS

SEQ ID NO. 90.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26L

XENP11819 H1.24_L1.4

SEQ ID NO. 91.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 92.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 93.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 94.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11820 H1.25_L1.4

SEQ ID NO. 95.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 96.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 97.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGQSYVSWFAYWGQGTLVTVSS

SEQ ID NO. 98.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26M

XENP11821 H1.26_L1.4

SEQ ID NO. 99.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 100.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 101.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNTYVSWFAYWGQGTLVTVSS

SEQ ID NO. 102.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11822 H1.27_L1.4

SEQ ID NO. 103.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 104.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 105.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFDYWGQGTLVTVSS

SEQ ID NO. 106.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26N

XENP11823 H1.28_L1.4

SEQ ID NO. 107.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 108.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 109.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTTVTVSS

SEQ ID NO. 110.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11824 H1.29_L1.30

SEQ ID NO. 111.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 112.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 113.
EVQLVESGGGLVQPGGSLRLSCAASGFTFNTYAMNWVRQAPGKSLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 114.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26O

XENP11825 H1_L1.10

SEQ ID NO. 115.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 116.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 117.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 118.
QAVVTQPPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11826 H1_L1.11

SEQ ID NO. 119.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 120.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 121.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 122.
QAVVTQEPSLSVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26P

XENP11827 H1_L1.12

SEQ ID NO. 123.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 124.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 125.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 126.
QAVVTQEPSLTVSPGATVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP11828 H1_L1.13

SEQ ID NO. 127.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 128.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 129.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 130.
QAVVTQEPSLTVSPGQTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26Q

XENP11829 H1_L1.14

SEQ ID NO. 131.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 132.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

SEQ ID NO. 133.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 134.
QAVVTQEPSLTVSPGGTVTLTCGSSTGAVTSSNYANWVQQKPGQAPRGLIGGTNKRAPGVPARFSGSLLG
GKAALTLSGAQPEDEAEYYCALWYSNLWVFGGGTKLTVL

XENP11830 H1_L1.15

SEQ ID NO. 135.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 136.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

SEQ ID NO. 137.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 138.
QAVVTQEPSLTVSPGGTVTLTCGSSTGAVTSGHYANWVQQKPGQAPRGLIGGTNKRAPGVPARFSGSLLG
GKAALTLSGAQPEDEAEYYCALWYSNLWVFGGGTKLTVL

Figure 26R

XENP11831 H1_L1.16

SEQ ID NO. 139.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVLGSHHHHHH

SEQ ID NO. 140.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

SEQ ID NO. 141.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 142.
QAVVTQEPSLTVSPGGTVTLTCGSSTGAVTTSNYANWVQQKPGQAPRGLIYDTNKRAPGVPARFSGSLLG
GKAALTLSGAQPEDEAEYYCALWYSNLWVFGGGTKLTVL

XENP11832 H1_L1.17

SEQ ID NO. 143.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVLGSHHHHHH

SEQ ID NO. 144.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

SEQ ID NO. 145.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 146.
QAVVTQEPSLTVSPGGTVTLTCGSSTGAVTTSNYANWVQQKPGQAPRGLIGGTNNRAPGVPARFSGSLLG
GKAALTLSGAQPEDEAEYYCALWYSNLWVFGGGTKLTVL

Figure 26S

XENP11833 H1_L1.18

SEQ ID NO. 147.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVLGSHHHHHH

SEQ ID NO. 148.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

SEQ ID NO. 149.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 150.
QAVVTQEPSLTVSPGGTVTLTCGSSTGAVTTSNYANWVQQKPGQAPRGLIGGTNKRASGVPARFSGSLLG
GKAALTLSGAQPEDEAEYYCALWYSNLWVFGGGTKLTVL

XENP11834 H1_L1.19

SEQ ID NO. 151.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVLGSHHHHHH

SEQ ID NO. 152.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

SEQ ID NO. 153.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 154.
QAVVTQEPSLTVSPGGTVTLTCGSSTGAVTTSNYANWVQQKPGQAPRGLIGGTSNKHSWTPARFSGSLLG
GKAALTLSGAQPEDEAEYYCALWYSNLWVFGGGTKLTVL

Figure 26T

XENP11835 H1_L1.20

SEQ ID NO. 155.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVLGSHHHHHH

SEQ ID NO. 156.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

SEQ ID NO. 157.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 158.
QAVVTQEPSLTVSPGGTVTLTCGSSTGAVTTSNYANWVQQKPGQAPRGLIGGTNKRAPGVPDRFSGSLLG
GKAALTLSGAQPEDEAEYYCALWYSNLWVFGGGTKLTVL

XENP11836 H1_L1.21

SEQ ID NO. 159.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVLGSHHHHHH

SEQ ID NO. 160.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

SEQ ID NO. 161.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 162.
QAVVTQEPSLTVSPGGTVTLTCGSSTGAVTTSNYANWVQQKPGQAPRGLIGGTNKRAPGVPARFSGSKSG
GKAALTLSGAQPEDEAEYYCALWYSNLWVFGGGTKLTVL

Figure 26U

XENP11837 H1_L1.22

SEQ ID NO. 163.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVLGSHHHHHH

SEQ ID NO. 164.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

SEQ ID NO. 165.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 166.
QAVVTQEPSLTVSPGGTVTLTCGSSTGAVTTSNYANWVQQKPGQAPRGLIGGTNKRAPGVPARFSGSSSG
GKAALTLSGAQPEDEAEYYCALWYSNLWVFGGGTKLTVL

XENP11838 H1_L1.23

SEQ ID NO. 167.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVLGSHHHHHH

SEQ ID NO. 168.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

SEQ ID NO. 169.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 170.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNLWVFGGGTKLTVL

Figure 26V

XENP11839 H1_L1.24

SEQ ID NO. 171.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVLGSHHHHHH

SEQ ID NO. 172.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

SEQ ID NO. 173.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 174.
QAVVTQEPSLTVSPGGTVTLTCGSSTGAVTTSNYANWVQQKPGQAPRGLIGGTNKRAPGVPARFSGSLLG
GKAALTLSGAQAEDEAEYYCALWYSNLWVFGGGTKLTVL

XENP11840 H1_L1.25

SEQ ID NO. 175.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVLGSHHHHHH

SEQ ID NO. 176.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

SEQ ID NO. 177.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 178.
QAVVTQEPSLTVSPGGTVTLTCGSSTGAVTTSNYANWVQQKPGQAPRGLIGGTNKRAPGVPARFSGSLLG
GKAALTLSGAQSEDEAEYYCALWYSNLWVFGGGTKLTVL

Figure 26W

XENP11841 H1_L1.26

SEQ ID NO. 179.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVLGSHHHHHH

SEQ ID NO. 180.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

SEQ ID NO. 181.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 182.
QAVVTQEPSLTVSPGGTVTLTCGSSTGAVTTSNYANWVQQKPGQAPRGLIGGTNKRAPGVPARFSGSLLG
GKAALTLSGAQPEDEADYYCALWYSNLWVFGGGTKLTVL

XENP11842 H1_L1.27

SEQ ID NO. 183.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVLGSHHHHHH

SEQ ID NO. 184.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

SEQ ID NO. 185.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 186.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCLLWYSNLWVFGGGTKLTVL

Figure 26X

XENP11843 H1_L1.28

SEQ ID NO. 187.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVLGSHHHHHH

SEQ ID NO. 188.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

SEQ ID NO. 189.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 190.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNHWVFGGGTKLTVL

XENP11844 H1_L1.29

SEQ ID NO. 191.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGSHHHHHH

SEQ ID NO. 192.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

SEQ ID NO. 193.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 194.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLEIKGS

Figure 26Y

XENP11920 H1_L3.1

SEQ ID NO. 195.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGSHHHHHH

SEQ ID NO. 196.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

SEQ ID NO. 197.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 198.
EIVMTQSPATLSLSPGERATLSCRSSTGAVTTSNYANWVQQKPGQAPRGLIGGTNKRAPGVPARFSGSGS
GTDFTLTISSLQPEDFAVYYCALWYSNLWVFGGGTKVEIKGS

XENP11921 H1_L5.1

SEQ ID NO. 199.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGSHHHHHH

SEQ ID NO. 200.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

SEQ ID NO. 201.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 202.
DIVMTQSPDSLAVSLGERATINCKSSTGAVTTSNYANWVQQKPGQPPKGLIGGTNKRAPGVPDRFSGSGS
GTDFTLTISSLQAEDVAVYYCALWYSNLWVFGGGTKVEIKGS

Figure 26Z

XENP11922 H1_L1.31

SEQ ID NO. 203.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVLGSHHHHHH

SEQ ID NO. 204.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

SEQ ID NO. 205.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 206.
QAVVTQEPSLTVSPGGTVTLTCGSSTGAVTTSNYANWVQQKPGQAPRGLIGGTNKRAPGVPARFSGSLLG
GKAALTDSGAQPEDEADYYCALWYSNHWVFGGGTKLTVL

XENP11923 H1_L1.32

SEQ ID NO. 207.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 208.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 209.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 210.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

Figure 26AA

XENP12107 H1.38_L1.4

SEQ ID NO. 211.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 212.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 213.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTATYYCVRHGNFGNSYVSWFAYWGQGTLVTVSS

SEQ ID NO. 214.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12108 H1_L1.33

SEQ ID NO. 215.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVLGSHHHHHH

SEQ ID NO. 216.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLTVL

SEQ ID NO. 217.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 218.
QAVVTQEPSLTVSPGGTVTLTCGSSTGAVTTSNYANWVQQKPGKAPRGLIGGTNKRAPGVPARFSGSLLG
GKAALTLSGAQPEDEAEYYCALWYSNLWVFGGGTKLT

Figure 26BB

XENP12109 H1_L1.34

SEQ ID NO. 219.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGTAPRGLI<u>GGTNKRAP</u>GVPARFSGSLLG
GKAALTLSGAQPEDEAEYYC<u>ALWYSNLWV</u>FGGGTKLTVLGSHHHHHH

SEQ ID NO. 220.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGTAPRGLI<u>GGTNKRAP</u>GVPARFSGSLLG
GKAALTLSGAQPEDEAEYYC<u>ALWYSNLWV</u>FGGGTKLTVL

SEQ ID NO. 221.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSS

SEQ ID NO. 222.
QAVVTQEPSLTVSPGGTVTLTC<u>GSSTGAVTTSNYAN</u>WVQQKPGTAPRGLI<u>GGTNKRAP</u>GVPARFSGSLLG
GKAALTLSGAQPEDEAEYYC<u>ALWYSNLWV</u>FGGGTKLTVL

XENP12110 H1_L1.35

SEQ ID NO. 223.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGSPPRGLI<u>GGTNKRAP</u>GVPARFSGSLLG
GKAALTLSGAQPEDEAEYYC<u>ALWYSNLWV</u>FGGGTKLTVLGSHHHHHH

SEQ ID NO. 224.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSSGGGGSGGGGSGGGGS
QAVVTQEPSLTVSPGGTVTLTC<u>GSSTGAVTTSNYAN</u>WVQQKPGSPPRGLI<u>GGTNKRAP</u>GVPARFSGSLLG
GKAALTLSGAQPEDEAEYYC<u>ALWYSNLWV</u>FGGGTKLTVL

SEQ ID NO. 225.
EVQLVESGGGLVQPGGSLRLSCAASGFTF<u>NTYAMN</u>WVRQAPGKGLEWVG<u>RIRSKYNNYATYYADSVKGRF</u>
TISRDDSKNTLYLQMNSLRAEDTAVYYCVR<u>HGNFGNSYVSWFAY</u>WGQGTLVTVSS

SEQ ID NO. 226.
QAVVTQEPSLTVSPGGTVTLTC<u>GSSTGAVTTSNYAN</u>WVQQKPGSPPRGLI<u>GGTNKRAP</u>GVPARFSGSLLG
GKAALTLSGAQPEDEAEYYC<u>ALWYSNLWV</u>FGGGTKLTVL

Figure 26CC

XENP12111 H1_L1.36

SEQ ID NO. 227.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVLGSHHHHHH

SEQ ID NO. 228.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

SEQ ID NO. 229.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 230.
QAVVTQEPSLTVSPGGTVTLTCGSSTGAVTTSNYANWVQQKPGQPPRGLIGGTNKRAPGVPARFSGSLLG
GKAALTLSGAQPEDEAEYYCALWYSNLWVFGGGTKLTVL

XENP12112 H1_L1.37

SEQ ID NO. 231.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVLGSHHHHHH

SEQ ID NO. 232.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

SEQ ID NO. 233.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 234.
QAVVTQEPSLTVSPGGTVTLTCGSSTGAVTTSNYANWVQQKPGQGPRGLIGGTNKRAPGVPARFSGSLLG
GKAALTLSGAQPEDEAEYYCALWYSNLWVFGGGTKLTVL

Figure 26DD

XENP12113 H1_L1.38

SEQ ID NO. 235.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVLGSHHHHHH

SEQ ID NO. 236.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

SEQ ID NO. 237.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 238.
QAVVTQEPSLTVSPGGTVTLTCGSSTGAVTTSNYANWVQQKPGQSPRGLIGGTNKRAPGVPARFSGSLLG
GKAALTLSGAQPEDEAEYYCALWYSNLWVFGGGTKLTVL

XENP12114 H1_L1.39

SEQ ID NO. 239.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVLGSHHHHHH

SEQ ID NO. 240.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

SEQ ID NO. 241.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 242.
QAVVTQEPSLTVSPGGTVTLTCGSSTGAVTTSNYANWVQQKPGQDPRGLIGGTNKRAPGVPARFSGSLLG
GKAALTLSGAQPEDEAEYYCALWYSNLWVFGGGTKLTVL

Figure 26EE

XENP12131 H1.30_L1.4

SEQ ID NO. 243.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 244.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 245.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 246.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12132 H1.31_L1.4

SEQ ID NO. 247.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 248.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 249.
EVQLVESGGGLVQPGGSLRLSCAASGFTFSTYAMSWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 250.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26FF

XENP12133 H1.32_L1.4

SEQ ID NO. 251.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 252.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 253.
EVQLVESGGGLVQPGGSLRLSCAASGFTFSTYAMNWVRQAPGKGLEWVGRIRSKANNYATYYADSVKGRF
TISRDDSKNTLYLQMNSLRAEDTAVYYCVRHGNFGDSYVSWFAYWGQGTLVTVSS

SEQ ID NO. 254.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12134 H1.33_L1.4

SEQ ID NO. 255.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 256.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 257.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFDYWGQGTLVTVSS

SEQ ID NO. 258.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26GG

XENP12135 H1.34_L1.4

SEQ ID NO. 259.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 260.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 261.
EVQLVESGGGLVQPGGSLRLSCAASGFTFSTYAMSWVRQAPGKGLEWVGRIRSKANNYATYYADSVKGRF
TISRDDSKNTLYLQMNSLRAEDTAVYYCVRHGNFGDSYVSWFDYWGQGTLVTVSS

SEQ ID NO. 262.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12136 H1.35_L1.4

SEQ ID NO. 263.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 264.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 265.
EVQLVESGGEVKKPGESLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 266.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26HH

XENP12137 H1.36_L1.4

SEQ ID NO. 267.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVLGSHHHHHH

SEQ ID NO. 268.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSSGGGGSGGGGSGGGGSQA
VVTQEPSLTVSPGGTVTLTCGSSTGAVTTSNYANWVQQKPGQAPRGLIGGTNKRAPGVPARFSGSLLGGK
AALTLSGAQPEDEAEYYCALWYSNLWVFGGGTKLTVL

SEQ ID NO. 269.
EVQLVESGGGLVQPGGSLRLSCAASGFTFNTYAMNWVRQAPGKGLEWVGRIRSNGGSTYYADSVKGRFTI
SRDDSKNTLYLQMNSLRAEDTAVYYCVRHGNFGNSYVSWFAYWGQGTLVTVSS

SEQ ID NO. 270.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

XENP12138 H1.37_L1.4

SEQ ID NO. 271.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVLGSHHHHHH

SEQ ID NO. 272.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

SEQ ID NO. 273.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 274.
QAVVTQEPSLTVSPGGTVTLTCGSSTGAVTTSNYANWVQQKPGQAPRGLIGGTNKRAPGVPARFSGSLLG
GKAALTLSGAQPEDEAEYYCALWYSNLWVFGGGTKLTVL

Figure 26II

XENP12139 H1.37_L1.32

SEQ ID NO. 275.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVLGSHHHHHH

SEQ ID NO. 276.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

SEQ ID NO. 277.
EVQLVESGGGLVQPGGSLRLSCAASGFTFNTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 278.
QAVVTQEPSLTVSPGGTVTLTCGSSTGAVTTSNYANWVQEKPGQAPRGLIGGTNKRAPGVPARFSGSLLG
GKAALTLSGAQPEDEAEYYCALWYSNLWVFGGGTKLTVL

XENP12149 H1_L1.40

SEQ ID NO. 279.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 280.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 281.
EVQLVESGGGLVQPGGSLRLSCAASGFTFNTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 282.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 26JJ

XENP12213 H1.30_L1.40

SEQ ID NO. 283.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 284.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 285.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 286.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12214 H1.8_L1.40

SEQ ID NO. 287.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 288.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 289.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 290.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 26KK

XENP12215 H1.39_L1.40

SEQ ID NO. 291.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 292.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 293.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 294.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

XENP12216 H1.40_L1.40

SEQ ID NO. 295.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVLGSHHHHHH

SEQ ID NO. 296.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

SEQ ID NO. 297.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 298.
QAVVTQEPSLTVSPGGTVTLTCGSSTGAVTTSNYANWVQQKPGQAPRGLIGGTNKRAPGVPARFSGSLLG
GKAALTISGAQPEDEADYYCALWYSNHWVFGGGTKLTVL

Figure 26LL

XENP12217 H1.30_L1.41

SEQ ID NO. 299.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 300.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 301.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 302.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12218 H1.8_L1.41

SEQ ID NO. 303.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 304.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 305.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 306.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 26MM

XENP12219 H1.39_L1.41

SEQ ID NO. 307.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 308.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 309.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 310.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

XENP12220 H1.40_L1.41

SEQ ID NO. 311.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVLGSHHHHHH

SEQ ID NO. 312.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

SEQ ID NO. 313.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 314.
QAVVTQEPSLTVSPGGTVTLTCGSSTGAVTTSNYANWVQQKPGQAPRGLIGGTNKRAPGVPARFSGSLLG
GKAALTISGAQPEDEAEYYCALWYSNHWVFGGGTKLTVL

Figure 26NN

XENP12221 H1.30_L1.42

SEQ ID NO. 315.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 316.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 317.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 318.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12222 H1.8_L1.42

SEQ ID NO. 319.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 320.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 321.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 322.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 26OO

XENP12223 H1.39_L1.42

SEQ ID NO. 323.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 324.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 325.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 326.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

XENP12224 H1.40_L1.42

SEQ ID NO. 327.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVLGSHHHHHH

SEQ ID NO. 328.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

SEQ ID NO. 329.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 330.
QAVVTQEPSLTVSPGGTVTLTCGSSTGAVTTSNYANWVQQKPGKAPRGLIGGTNKRAPGVPARFSGSLLG
GKAALTISGAQPEDEAEYYCALWYSNHWVFGGGTKLTVL

Figure 26PP

XENP12225 H1.30_L1.43

SEQ ID NO. 331.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 332.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 333.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 334.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12226 H1.8_L1.43

SEQ ID NO. 335.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 336.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 337.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 338.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 26QQ

XENP12227 H1.39_L1.43

SEQ ID NO. 339.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 340.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 341.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 342.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

XENP12228 H1.40_L1.43

SEQ ID NO. 343.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVLGSHHHHHH

SEQ ID NO. 344.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

SEQ ID NO. 345.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 346.
QAVVTQEPSLTVSPGGTVTLTCGSSTGAVTTSNYANWVQQKPGQSPRGLIGGTNKRAPGVPARFSGSLLG
GKAALTISGAQPEDEAEYYCALWYSNHWVFGGGTKLTVL

Figure 26RR

XENP12229 H1.30_L1.44

SEQ ID NO. 347.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 348.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 349.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 350.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12230 H1.8_L1.44

SEQ ID NO. 351.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 352.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 353.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 354.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 26SS

XENP12231 H1.39_L1.44

SEQ ID NO. 355.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 356.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 357.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 358.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

XENP12232 H1.40_L1.44

SEQ ID NO. 359.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVLGSHHHHHH

SEQ ID NO. 360.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

SEQ ID NO. 361.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 362.
QAVVTQEPSLTVSPGGTVTLTCGSSTGAVTTSNYANWVQQKPGKSPRGLIGGTNKRAPGVPARFSGSLLG
GKAALTISGAQPEDEAEYYCALWYSNHWVFGGGTKLTVL

Figure 26TT

XENP12233 H1.30_L1.45

SEQ ID NO. 363.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 364.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 365.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 366.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12234 H1.8_L1.45

SEQ ID NO. 367.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 368.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 369.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 370.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 26UU

XENP12235 H1.39_L1.45

SEQ ID NO. 371.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 372.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 373.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 374.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

XENP12236 H1.40_L1.45

SEQ ID NO. 375.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVLGSHHHHHH

SEQ ID NO. 376.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

SEQ ID NO. 377.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 378.
QAVVTQEPSLTVSPGGTVTLTCGSSTGAVTTSNYANWVQQKPGKAPRGLIGGTNKRAPGVPARFSGSLLG
GKAALTISGAQPEDEADYYCALWYSNHWVFGGGTKLTVL

Figure 26VV

XENP12237 H1.30_L1.46

SEQ ID NO. 379.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 380.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 381.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 382.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12238 H1.8_L1.46

SEQ ID NO. 383.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 384.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 385.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 386.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 26WW

XENP12239 H1.39_L1.46

SEQ ID NO. 387.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 388.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 389.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 390.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

XENP12240 H1.40_L1.46

SEQ ID NO. 391.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVLGSHHHHHH

SEQ ID NO. 392.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

SEQ ID NO. 393.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 394.
QAVVTQEPSLTVSPGGTVTLTCGSSTGAVTTSNYANWVQQKPGQSPRGLIGGTNKRAPGVPARFSGSLLG
GKAALTISGAQPEDEADYYCALWYSNHWVFGGGTKLTVL

Figure 26XX

XENP12241 H1.30_L1.47

SEQ ID NO. 395.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 396.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 397.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 398.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12242 H1.8_L1.47

SEQ ID NO. 399.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 400.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 401.
EVQLVESGGGLVQPGGSLRLSCAASGFTFSTYAMNWVRQAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 402.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 26YY

XENP12243 H1.39_L1.47

SEQ ID NO. 403.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 404.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 405.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGNSYVSWFAYWGQGTLVTVSS

SEQ ID NO. 406.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

XENP12244 H1.40_L1.47

SEQ ID NO. 407.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLGSHHHHHH

SEQ ID NO. 408.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSSGGGGSGGGGSGGGGS
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

SEQ ID NO. 409.
EVQLVESGGGLVQPGGSLRLSCAASGFTFSTYAMNWVRKAPGKGLEWVGRIRSKYNNYATYYADSVKGRF
TISRDDSKNTLYLQMNSLRAEDTAVYYCVRHGNFGDSYVSWFAYWGQGTLVTVSS

SEQ ID NO. 410.
QAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVL

Figure 27A

| XENP | VH ID | VL ID | Yield (mg/L) | $T_m$ (°C) |
|---|---|---|---|---|
| 11502 | H1 | L1.4 | 13.39 | 62.7 |
| 11794 | H1.3 | L1.4 | 4.00 | 62 |
| 11795 | H1.4 | L1.4 | 18.01 | 62.5 |
| 11796 | H1.5 | L1.4 | 0.15 | 61.5 |
| 11801 | H1.6 | L1.4 | 2.13 | 62.5 |
| 11802 | H1.7 | L1.4 | 14.66 | 62.25 |
| 11803 | H1.8 | L1.4 | 1.85 | 64.125 |
| 11804 | H1.9 | L1.4 | 20.57 | 65 |
| 11805 | H1.10 | L1.4 | 29.45 | 68.5 |
| 11806 | H1.11 | L1.4 | 1.71 | 59.75 |
| 11807 | H1.12 | L1.4 | 6.27 | 63.375 |
| 11808 | H1.13 | L1.4 | 9.70 | 62.375 |
| 11809 | H1.14 | L1.4 | 3.22 | 63 |
| 11810 | H1.15 | L1.4 | 15.38 | 62 |
| 11811 | H1.16 | L1.4 | 3.98 | 58 |
| 11812 | H1.17 | L1.4 | 0.16 | 60 |
| 11813 | H1.18 | L1.4 | 9.09 | 61 |
| 11814 | H1.19 | L1.4 | 2.53 | 62 |
| 11815 | H1.20 | L1.4 | 5.29 | 62.5 |
| 11816 | H1.21 | L1.4 | 19.89 | 62 |
| 11817 | H1.22 | L1.4 | 7.38 | 59 |
| 11818 | H1.23 | L1.4 | 7.90 | 62 |
| 11819 | H1.24 | L1.4 | 3.10 | 63.125 |
| 11820 | H1.25 | L1.4 | 4.57 | 61.875 |
| 11821 | H1.26 | L1.4 | 57.12 | 61.5 |
| 11822 | H1.27 | L1.4 | 25.53 | 65.5 |
| 11823 | H1.28 | L1.4 | 6.66 | 62.5 |
| 11824 | H1.29 | L1.30 | 30.48 | 61 |
| 11825 | H1 | L1.10 | 18.02 | 62 |
| 11826 | H1 | L1.11 | 6.36 | 62.5 |
| 11827 | H1 | L1.12 | 19.82 | 61.75 |
| 11828 | H1 | L1.13 | 2.22 | 62 |
| 11829 | H1 | L1.14 | 20.47 | 62.5 |
| 11830 | H1 | L1.15 | 20.63 | 62 |
| 11831 | H1 | L1.16 | 34.29 | 61.75 |
| 11832 | H1 | L1.17 | 17.89 | 62.25 |
| 11833 | H1 | L1.18 | 3.85 | 60 |
| 11834 | H1 | L1.19 | 6.02 | 60.75 |
| 11835 | H1 | L1.20 | 22.46 | 62.5 |
| 11836 | H1 | L1.21 | 8.16 | 55 |
| 11837 | H1 | L1.22 | 3.51 | 56.75 |
| 11838 | H1 | L1.23 | 15.90 | 63.5 |

Figure 27B

| XENP | VH ID | VL ID | Yield (mg/L) | $T_m$ (°C) |
|---|---|---|---|---|
| 11839 | H1 | L1.24 | 15.94 | 61.75 |
| 11840 | H1 | L1.25 | 15.11 | 61.5 |
| 11841 | H1 | L1.26 | 7.30 | 64 |
| 11842 | H1 | L1.27 | 4.39 | 57.5 |
| 11843 | H1 | L1.28 | 15.61 | 62.875 |
| 11844 | H1 | L1.29 | 12.74 | 61.5 |
| 11920 | H1 | L3.1 | 0.72 | 52 |
| 11921 | H1 | L5.1 | 1.88 | 55.5 |
| 11922 | H1 | L1.31 | 8.89 | 58.25 |
| 11923 | H1 | L1.32 | 5.02 | 58.25 |
| 12107 | H1.38 | L1.4 | 19.28 | 62.5 |
| 12108 | H1 | L1.33 | 14.77 | 63 |
| 12109 | H1 | L1.34 | 10.77 | 62 |
| 12110 | H1 | L1.35 | 11.61 | 62.5 |
| 12111 | H1 | L1.36 | 17.51 | 62.5 |
| 12112 | H1 | L1.37 | 13.42 | 61 |
| 12113 | H1 | L1.38 | 13.03 | 63 |
| 12114 | H1 | L1.39 | 9.78 | 55.5 |
| 12131 | H1.30 | L1.4 | 12.73 | 65 |
| 12132 | H1.31 | L1.4 | 31.88 | 71 |
| 12133 | H1.32 | L1.4 | 24.00 | 65.5 |
| 12134 | H1.33 | L1.4 | 26.84 | 67.5 |
| 12135 | H1.34 | L1.4 | 40.40 | 72.5 |
| 12136 | H1.35 | L1.4 | 8.34 | 60.5 |
| 12137 | H1.36 | L1.4 | 4.30 | 60 |
| 12138 | H1.37 | L1.4 | 14.19 | 64.75 |
| 12139 | H1.37 | L1.32 | 6.75 | 63.5 |
| 12149 | H1 | L1.40 | 58.86 | 65.5 |

Figure 28A

| XENP | % Improvement from H1_L1.4 |
|---|---|
| 11796 | 125.1 |
| 11803 | 118.0 |
| 11804 | 12.2 |
| 11805 | 16.3 |
| 11807 | 31.6 |
| 11808 | 54.4 |
| 11809 | 40.2 |
| 11502 | 129.3 |
| 11819 | 69.2 |
| 11820 | 98.8 |
| 11822 | 7.6 |
| 11838 | 169.8 |
| 11841 | 95.1 |
| 11843 | 152.5 |
| 11794 | 112.1 |
| 11795 | 241.8 |
| 11801 | 77.1 |
| 11802 | 232.6 |
| 11806 | 93.8 |
| 11810 | 263.9 |
| 11811 | 42.4 |
| 11812 | 5.1 |
| 11813 | 107.4 |
| 11814 | 83.8 |
| 11815 | 173.6 |
| 11816 | 230.7 |
| 11817 | 46.4 |
| 11818 | 33.3 |
| 11823 | 127.3 |
| 11825 | 227.4 |
| 11826 | 137.3 |
| 11827 | 197.1 |
| 11828 | 82.3 |
| 11829 | 225.4 |
| 11830 | 206.7 |
| 11832 | 79.9 |
| 11833 | 35.7 |
| 11834 | 66.9 |
| 11835 | 194.7 |
| 11836 | 191.6 |

Figure 28B

| XENP | % Improvement from H1_L1.4 |
|---|---|
| 11837 | 73.9 |
| 11839 | 212.5 |
| 11840 | 204.0 |
| 11842 | 3.4 |
| 11844 | 112.3 |
| 12131 | 29.0 |
| 12132 | 0.1 |
| 12133 | 10.4 |
| 12134 | 1.0 |
| 12136 | 64.4 |
| 12137 | 0.1 |
| 12138 | 108.9 |
| 12108 | 145.2 |
| 12113 | 112.9 |
| 12149 | 128.7 |

Figure 29

HUMAN T-cell surface glycoprotein CD3 epsilon chain   SEQ ID NO: 459

MQSGTHWRVLGLCLLSVGVWGQDGNEEMGGITQTPYKVSISGTTVILTCPQYPG
SEILWQHNDKNIGGDEDDKNIGSDEDHLSLKEFSELEQSGYYVCYPRGSK
PEDANFYLYLRARVCENCMEMDVMSVATIVIVDICITGGLLLLVYYWSK
NRKAKAKPVTRGAGAGGRQRGQNKERPPPVPNPDYEPIRKGQRDLYSGL
NQRRI

Figure 30A

Optimized scFv CD3 variable regions

| Xen # | vhCDR1 | vhCDR2 | vhCDR3 | vlCDR1 | vlCDR2 | vlCDR3 |
|---|---|---|---|---|---|---|
| XENP11502 H1_L1.4 SEQ ID NO: 4 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11794 H1.3_L1.4 SEQ ID NO: 8 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11795 H1.4_L1.4 SEQ ID NO: 12 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11796 H1.5_L1.4 SEQ ID NO: 16 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11801 H1.6_L1.4 SEQ ID NO: 20 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11802 H1.7_L1.4 SEQ ID NO: 24 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11803 H1.8_L1.4 SEQ ID NO: 28 | TYAMN SEQ ID NO: 411 | RIRSKYNNYATYYADSVKG SEQ ID NO: 432 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11804 H1.9_L1.4 SEQ ID NO: 32 | TYAMN SEQ ID NO: 412 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11805 H1.10_L1.4 SEQ ID NO: 36 | TYAMS SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11806 H1.11_L1.4 SEQ ID NO: 40 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11807 H1.12_L1.4 SEQ ID NO: 44 | TYAMN SEQ ID NO: 411 | RIRSKANNYATYYADSVKG SEQ ID NO: 414 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 30B

| Xen # | vhCDR1 | vhCDR2 | vhCDR3 | vlCDR1 | vlCDR2 | vlCDR3 |
|---|---|---|---|---|---|---|
| XENP11808 H1.13_L1.4 SEQ ID NO: 48 | TYAMN SEQ ID NO: 411 | RIRSKANSYATYYADSVKG SEQ ID NO: 434 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11809 H1.14_L1.4 SEQ ID NO: 52 | TYAMN SEQ ID NO: 411 | RIRSKYNNYATAYADSVKG SEQ ID NO: 429 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11810 H1.15_L1.4 SEQ ID NO: 56 | TYAMN SEQ ID NO: 411 | RIRSKYNNYATYYAASVKG SEQ ID NO: 431 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11811 H1.16_L1.4 SEQ ID NO: 60 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11812 H1.17_L1.4 SEQ ID NO: 64 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11813 H1.18_L1.4 SEQ ID NO: 68 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11814 H1.19_L1.4 SEQ ID NO: 72 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11815 H1.20_L1.4 SEQ ID NO: 76 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11816 H1.21_L1.4 SEQ ID NO: 80 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11817 H1.22_L1.4 SEQ ID NO: 84 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11818 H1.23_L1.4 SEQ ID NO: 88 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11819 H1.24_L1.4 SEQ ID NO: 92 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |

Figure 30C

| Xen # | vhCDR1 | vhCDR2 | vhCDR3 | vlCDR1 | vlCDR2 | vlCDR3 |
|---|---|---|---|---|---|---|
| XENP11820 H1.25_L1.4 SEQ ID NO: 96 | TYAMN SEQ ID NO: 411 | RIRSKYNNYATYYADSVKG SEQ ID NO: 413 | HGNFGQSYVSWFAY SEQ ID NO: 418 | GSSTGAVTTSNYAN SEQ ID NO: 420 | GTNKRAP SEQ ID NO: 425 | ALWYSNLWV SEQ ID NO: 430 |
| XENP11821 H1.26_L1.4 SEQ ID NO: 100 | TYAMN SEQ ID NO: 411 | RIRSKYNNYATYYADSVKG SEQ ID NO: 413 | HGNFGNTYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11822 H1.27_L1.4 SEQ ID NO: 104 | TYAMN SEQ ID NO: 411 | RIRSKYNNYATYYADSVKG SEQ ID NO: 413 | HGNFGNSYVSWFDY SEQ ID NO: 461 | GSSTGAVTTSNYAN SEQ ID NO: 420 | GTNKRAP SEQ ID NO: 425 | ALWYSNLWV SEQ ID NO: 430 |
| XENP11823 H1.28_L1.4 SEQ ID NO: 108 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11824 H1.29_L1.30 SEQ ID NO: 112 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11825 H1_L1.10 SEQ ID NO: 116 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11826 H1_L1.11 SEQ ID NO: 120 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11827 H1_L1.12 SEQ ID NO: 124 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11828 H1_L1.13 SEQ ID NO: 128 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11829 H1_L1.14 SEQ ID NO: 132 | TYAMN SEQ ID NO: 411 | RIRSKYNNYATYYADSVKG SEQ ID NO: 413 | HGNFGNSYVSWFAY SEQ ID NO: 416 | GSSTGAVTSSNYAN SEQ ID NO: 421 | GTNKRAP SEQ ID NO: 425 | ALWYSNLWV SEQ ID NO: 430 |
| XENP11830 H1_L1.15 SEQ ID NO: 136 | TYAMN SEQ ID NO: 411 | RIRSKYNNYATYYADSVKG SEQ ID NO: 413 | HGNFGNSYVSWFAY SEQ ID NO: 416 | GSSTGAVTSGHYAN SEQ ID NO: 422 | GTNKRAP SEQ ID NO: 425 | ALWYSNLWV SEQ ID NO: 430 |
| XENP11831 H1_L1.16 SEQ ID NO: 140 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | DTNKRAP SEQ ID NO: 426 | ALWYSNLWV SEQ ID NO: 430 |

Figure 30D

| Xen # | vhCDR1 | vhCDR2 | vhCDR3 | vlCDR1 | vlCDR2 | vlCDR3 |
|---|---|---|---|---|---|---|
| XENP11832 H1_L1.17 SEQ ID NO: 144 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNNRAP SEQ ID NO: 427 | ALWYSNLWV SEQ ID NO: 430 |
| XENP11833 H1_L1.18 SEQ ID NO: 148 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAS SEQ ID NO: 428 | ALWYSNLWV SEQ ID NO: 430 |
| XENP11834 H1_L1.19 SEQ ID NO: 152 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTSNKHS SEQ ID NO: 462 | ALWYSNLWV SEQ ID NO: 430 |
| XENP11835 H1_L1.20 SEQ ID NO: 156 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11836 H1_L1.21 SEQ ID NO: 160 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11837 H1_L1.22 SEQ ID NO: 164 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11838 H1_L1.23 SEQ ID NO: 168 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11839 H1_L1.24 SEQ ID NO: 172 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11840 H1_L1.25 SEQ ID NO: 176 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11841 H1_L1.26 SEQ ID NO: 180 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11842 H1_L1.27 SEQ ID NO: 184 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | LLWYSNLWV SEQ ID NO: 417 |
| XENP11843 H1_L1.28 SEQ ID NO: 188 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |

Figure 30E

| Xen # | vhCDR1 | vhCDR2 | vhCDR3 | vlCDR1 | vlCDR2 | vlCDR3 |
|---|---|---|---|---|---|---|
| XENP11844 H1_L1.29 SEQ ID NO: 192 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP11920 H1_L3.1 SEQ ID NO: 196 | TYAMN SEQ ID NO: 411 | RIRSKYNNYATYYADSVKG SEQ ID NO: 413 | HGNFGNSYVSWFAY SEQ ID NO: 416 | RSSTGAVTTSNYAN SEQ ID NO: 423 | GTNKRAP SEQ ID NO: 425 | ALWYSNLWV SEQ ID NO: 430 |
| XENP11921 H1_L5.1 SEQ ID NO: 200 | TYAMN SEQ ID NO: 411 | RIRSKYNNYATYYADSVKG SEQ ID NO: 413 | HGNFGNSYVSWFAY SEQ ID NO: 416 | KSSTGAVTTSNYAN SEQ ID NO: 424 | GTNKRAP SEQ ID NO: 425 | ALWYSNLWV SEQ ID NO: 430 |
| XENP11922 H1_L1.31 SEQ ID NO: 204 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP11923 H1_L1.32 SEQ ID NO: 208 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12107 H1.38_L1.4 SEQ ID NO: 212 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12108 H1_L1.33 SEQ ID NO: 216 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12109 H1_L1.34 SEQ ID NO: 220 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12110 H1_L1.35 SEQ ID NO: 224 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12111 H1_L1.36 SEQ ID NO: 228 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12112 H1_L1.37 SEQ ID NO: 232 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12113 H1_L1.38 SEQ ID NO: 236 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |

Figure 30F

| Xen # | vhCDR1 | vhCDR2 | vhCDR3 | vlCDR1 | vlCDR2 | vlCDR3 |
|---|---|---|---|---|---|---|
| XENP12114 H1_L1.39 SEQ ID NO: 240 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12131 H1.30_L1.4 SEQ ID NO: 244 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12132 H1.31_L1.4 SEQ ID NO: 248 | TYAMS SEQ ID NO: 412 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12133 H1.32_L1.4 SEQ ID NO: 252 | TYAMN SEQ ID NO: 411 | RIRSKANNYATYYADSVKG SEQ ID NO: 414 | HGNFGDSYVSWFAY SEQ ID NO: 417 | GSSTGAVTTSNYAN SEQ ID NO: 420 | GTNKRAP SEQ ID NO: 425 | ALWYSNLWV SEQ ID NO: 430 |
| XENP12134 H1.33_L1.4 SEQ ID NO: 256 | TYAMN SEQ ID NO: 411 | RIRSKANNYATYYADSVKG SEQ ID NO: 414 | HGNFGDSYVSWFDY SEQ ID NO: 419 | GSSTGAVTTSNYAN SEQ ID NO: 420 | GTNKRAP SEQ ID NO: 425 | ALWYSNLWV SEQ ID NO: 430 |
| XENP12135 H1.34_L1.4 SEQ ID NO: 260 | TYAMS SEQ ID NO: 412 | RIRSKYNNYATYYADSVKG SEQ ID NO: 413 | HGNFGDSYVSWFDY SEQ ID NO: 419 | GSSTGAVTTSNYAN SEQ ID NO: 420 | GTNKRAP SEQ ID NO: 425 | ALWYSNLWV SEQ ID NO: 430 |
| XENP12136 H1.35_L1.4 SEQ ID NO: 264 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12137 H1.36_L1.4 SEQ ID NO: 268 | TYAMN SEQ ID NO: 411 | RIRSNGGSTYYADSVKG SEQ ID NO: 415 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12138 H1.37_L1.4 SEQ ID NO: 272 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12139 H1.37_L1.32 SEQ ID NO: 276 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNLWV SEQ ID NO: 430 |
| XENP12149 H1_L1.40 SEQ ID NO: 280 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12213 H1.30_L1.40 SEQ ID NO: 284 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 30G

| Xen # | vhCDR1 | vhCDR2 | vhCDR3 | vlCDR1 | vlCDR2 | vlCDR3 |
|---|---|---|---|---|---|---|
| XENP12214 H1.8_L1.40 SEQ ID NO: 288 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12215 H1.39_L1.40 SEQ ID NO: 292 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12216 H1.40_L1.40 SEQ ID NO: 296 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12217 H1.30_L1.41 SEQ ID NO: 300 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12218 H1.8_L1.41 SEQ ID NO: 304 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12219 H1.39_L1.41 SEQ ID NO: 308 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12220 H1.40_L1.41 SEQ ID NO: 312 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12221 H1.30_L1.42 SEQ ID NO: 316 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12222 H1.8_L1.42 SEQ ID NO: 320 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12223 H1.39_L1.42 SEQ ID NO: 324 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12224 H1.40_L1.42 SEQ ID NO: 328 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12225 H1.30_L1.43 SEQ ID NO: 332 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 30H

| Xen # | vhCDR1 | vhCDR2 | vhCDR3 | vlCDR1 | vlCDR2 | vlCDR3 |
|---|---|---|---|---|---|---|
| XENP12226 H1.8_L1.43 SEQ ID NO: 336 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12227 H1.39_L1.43 SEQ ID NO: 340 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12228 H1.40_L1.43 SEQ ID NO: 344 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12229 H1.30_L1.44 SEQ ID NO: 348 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12230 H1.8_L1.44 SEQ ID NO: 352 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12231 H1.39_L1.44 SEQ ID NO: 356 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12232 H1.40_L1.44 SEQ ID NO: 360 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12233 H1.30_L1.45 SEQ ID NO: 364 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12234 H1.8_L1.45 SEQ ID NO: 368 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12235 H1.39_L1.45 SEQ ID NO: 372 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12236 H1.40_L1.45 SEQ ID NO: 376 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12237 H1.30_L1.46 SEQ ID NO: 380 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |

Figure 30I

| Xen # | vhCDR1 | vhCDR2 | vhCDR3 | vlCDR1 | vlCDR2 | vlCDR3 |
|---|---|---|---|---|---|---|
| XENP12238 H1.8_L1.46 SEQ ID NO: 384 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12239 H1.39_L1.46 SEQ ID NO: 388 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12240 H1.40_L1.46 SEQ ID NO: 392 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12241 H1.30_L1.47 SEQ ID NO: 396 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP12242 H1.8_L1.47 SEQ ID NO: 400 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12243 H1.39_L1.47 SEQ ID NO: 404 | TYAMN SEQ ID NO: 411 | RIRSKYNNYATYYADSVKG SEQ ID NO: 413 | HGNFGNSYVSWFAY SEQ ID NO: 416 | GSSTGAVTTSNYAN SEQ ID NO: 420 | GTNKRAP SEQ ID NO: 425 | ALWYSNHWV SEQ ID NO: 433 |
| XENP12244 H1.40_L1.47 SEQ ID NO: 408 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| XENP ?? SEQ ID NO: 1 and 2 | TYAMN SEQ ID NO: 411 | RIRSKYNNYATYYADSVKG SEQ ID NO: 413 | HGNFGDSYVSWFAY SEQ ID NO: 417 | GSSTGAVTTSNYAN SEQ ID NO: 420 | GTNKRAP SEQ ID NO: 425 | ALWYSNHWV SEQ ID NO: 433 |
| Consensus sequences | TYAMXaa1, wherein Xaa1 is N, S or H (SEQ ID NO:435) | R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436) | H-G-N-F-G-Xaa1-S-Y-V-S-W-F-Xaa2-Y, wherein Xaa1 is N, D or Q and Xaa2 is A or D (SEQ ID NO:437) | Xaa1-S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438) | Xaa1-T-N-Xaa2-R-A-Xaa3, wherein Xaa1 is G or D, Xaa2 is K or N, and Xaa3 is P or S (SEQ ID NO:439) | Xaa1-L-W-Y-S-N-Xaa2-W-V, wherein Xaa1 is A or L and Xaa2 is L or H (SEQ ID NO:440) |

Figure 31

Positive charged scFv linkers

| Name | Sequence | Length | Charge | SEQ ID NO: |
|---|---|---|---|---|
| Gly-Ser 15 | GGGGSGGGGSGGGGS | 15 | 0 | 463 |
| Whitlow linker | GSTSGSGKPGSGEGSTKG | 18 | +1 | 464 |
| 6paxA_1 (+A) | IRPRAIGGSKPRVA | 14 | +4 | 465 |
| +B | GKGGSGKGGSGKGGS | 15 | +3 | 466 |
| +C | GGKGSGGKGSGGKGS | 15 | +3 | 467 |
| +D | GGGKSGGGKSGGGKS | 15 | +3 | 468 |
| +E | GKGKSGKGKSGKGKS | 15 | +6 | 469 |
| +F | GGGKSGGKGSGKGGS | 15 | +3 | 470 |
| +G | GKPGSGKPGSGKPGS | 15 | +3 | 471 |
| +H | GKPGSGKPGSGKPGSGKPGS | 20 | +4 | 472 |
| +I | GKGKSGKGKSGKGKSGKGKS | 20 | +8 | 473 |

Negative charged scFv linkers

| Name | Sequence | Length | Charge | |
|---|---|---|---|---|
| Gly-Ser 15 | GGGGSGGGGSGGGGSGGGGS | 20 | 0 | 474 |
| 3hsc_2 (-A) | STAGDTHLGGEDFD | 14 | -4 | 475 |
| -B | GEGGSGEGGSGEGGS | 15 | -3 | 476 |
| -C | GGEGSGGEGSGGEGS | 15 | -3 | 477 |
| -D | GGGESGGGESGGGES | 15 | -3 | 478 |
| -E | GEGESGEGESGEGES | 15 | -6 | 479 |
| -F | GGGESGGEGSGEGGS | 15 | -3 | 480 |
| -G | GEGESGEGESGEGESGEGES | 20 | -8 | 481 |

Figure 32A

| Monomer 1 | Monomer 2 |
|---|---|
| ISO(-) side | ISO(+RR) side |
| T411E | D401K |
| T411E K360D | D401K |
| T411E K360E | D401K |
| T411E Q362E | D401K |
| T411E N390D | D401K |
| T411E | D401K Q347K |
| T411E | D401K Q347R |
| T411E K360D Q362E | D401K |
| T411E K360E Q362E | D401K |
| T411E K360E N390D | D401K |
| T411E Q362E N390D | D401K |
| T411E Q347R | D401K K360D |
| T411E Q347R | D401K K360E |
| T411E K360D | D401K Q347K |
| T411E K360D | D401K Q347R |
| T411E K360E | D401K Q347K |
| T411E K360E | D401K Q347R |
| T411E S364K | D401K K370S |
| T411E K370S | D401K S364K |
| Q347E | E357Q |
| Q347E | E357Q Q362K |

Figure 32B

| Monomer 1 | Monomer 2 |
|---|---|
| K360D Q362E | Q347R |
| K360D Q362E | D401K |
| K360D Q362E | Q347R D401K |
| K360E Q362E | Q347R |
| K360E Q362E | D401K |
| K360E Q362E | Q347R D401K |
| Q362E N390D | D401K |
| Q347E K360D | D401N |
| K360D | Q347R N390K |
| K360D | N390K D401N |
| K360E | Y349H |
| K370S Q347E | S364K |
| K370S E357L | S364K |
| K370S E357Q | S364K |
| K370S Q347E E357L | S364K |
| K370S Q347E E357Q | S364K |
| L368D K370S Q347E | S364K |
| L368D K370S E357L | S364K |
| L368D K370S E357Q | S364K |
| L368D K370S Q347E E357L | S364K |
| L368D K370S Q347E E357Q | S364K |
| L368E K370S Q347E | S364K |
| L368E K370S E357L | S364K |
| L368E K370S E357Q | S364K |
| L368E K370S Q347E E357L | S364K |
| L368E K370S Q347E E357Q | S364K |

Figure 32C

| Monomer 1 | Monomer 2 |
|---|---|
| L368D  K370T  Q347E | S364K |
| L368D  K370T  E357L | S364K |
| L368D  K370T  E357Q | S364K |
| L368D  K370T  Q347E  E357L | S364K |
| L368D  K370T  Q347E  E357Q | S364K |
| L368E  K370T  Q347E | S364K |
| L368E  K370T  E357L | S364K |
| L368E  K370T  E357Q | S364K |
| L368E  K370T  Q347E  E357L | S364K |
| L368E  K370T  Q347E  E357Q | S364K |
| T411E  Q362E | D401K  T411K |
| T411E  N390D | D401K  T411K |
| T411E  Q362E | D401R  T411R |
| T411E  N390D | D401R  T411R |

FIGURE 33 Ablation Variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | |
| A327Q | |
| L328E | |
| L328R | |
| P329A | |
| P329H | |

HETERODIMERIC PROTEINS

CROSS-REFERENCE TO RELATED APPLICATIONS

This application claims priority to U.S. Provisional Patent Applications No. 61/752,348 filed on Jan. 14, 2013, and No. 61/764,954 filed on Feb. 14, 2013, and No. 61/780,334 filed on Mar. 13, 2013, and No. 61/818,410 filed on May 1, 2013, and No. 61/778,157 filed on Mar. 12, 2013, and No. 61/913,832 filed on Dec. 9, 2013, and No. 61/818,153 filed on May 1, 2013 and No. 61/913,870 filed on Dec. 9, 2013 the entire contents of which are incorporated herein for all purposes by this reference.

INCORPORATION OF RELATED APPLICATIONS

The following applications are incorporated by reference in their entirety, U.S. Ser. Nos. 61/302,707, 61/732,813, 61/598,686, 61/441,552, 61/311,472, 61/450,457, 61/545,498, 61/368,969, 61/391,509, 61/391,515, 61/439,263, 61/368,962 and 61/593,846, 61/515,745, 61/752,349, 13/194,904, 13/568,028, 13/648,951, 12/875,015, as well as US Publication Nos. 2009/0163,699 and 2006/0024298.

TECHNICAL FIELD

The present invention describes novel immunoglobulin compositions that simultaneously co-engage antigens, where both of the antigens are bound monovalently. The novel immunoglobulins described preferably utilize heterodimeric Fc regions. Methods of using the novel immunoglobulin compositions, particularly for therapeutic purposes, are also described herein.

BACKGROUND OF THE INVENTION

Antibody-based therapeutics have been used successfully to treat a variety of diseases, including cancer and autoimmune/inflammatory disorders. Yet improvements to this class of drugs are still needed, particularly with respect to enhancing their clinical efficacy. One avenue being explored is the engineering of additional and novel antigen binding sites into antibody-based drugs such that a single immunoglobulin molecule co-engages two different antigens. Such non-native or alternate antibody formats that engage two different antigens are often referred to as bispecifics. Because the considerable diversity of the antibody variable region (Fv) makes it possible to produce an Fv that recognizes virtually any molecule, the typical approach to bispecific generation is the introduction of new variable regions into the antibody.

A number of alternate antibody formats have been explored for bispecific targeting (Chames & Baty, 2009, mAbs 1[6]:1-9; Holliger & Hudson, 2005, Nature Biotechnology 23[9]:1126-1136; and Kontermann, 2012 MAbs 4(2):182, all of which are expressly incorporated herein by reference). Initially, bispecific antibodies were made by fusing two cell lines that each produced a single monoclonal antibody (Milstein et al., 1983, Nature 305:537-540). Although the resulting hybrid hybridoma or quadroma did produce bispecific antibodies, they were only a minor population, and extensive purification was required to isolate the desired antibody. An engineering solution to this was the use of antibody fragments to make bispecifics. Because such fragments lack the complex quaternary structure of a full length antibody, variable light and heavy chains can be linked in single genetic constructs. Antibody fragments of many different forms have been generated, including diabodies, single chain diabodies, tandem scFv's, and $Fab_2$ bispecifics (Chames & Baty, 2009, mAbs 1[6]:1-9; Holliger & Hudson, 2005, Nature Biotechnology 23[9]:1126-1136; expressly incorporated herein by reference). While these formats can be expressed at high levels in bacteria and may have favorable penetration benefits due to their small size, they clear rapidly in vivo and can present manufacturing obstacles related to their production and stability. A principal cause of these drawbacks is that antibody fragments typically lack the constant region of the antibody with its associated functional properties, including larger size, high stability, and binding to various Fc receptors and ligands that maintain long half-life in serum (i.e., the neonatal Fc receptor FcRn) or serve as binding sites for purification (i.e., protein A and protein G).

More recent work has attempted to address the shortcomings of fragment-based bispecifics by engineering dual binding into full length antibody-like formats (Wu et al., 2007, Nature Biotechnology 25[11]:1290-1297; U.S. Ser. No. 12/477,711; Michaelson et al., 2009, mAbs 1[2]:128-141; PCT/US2008/074693; Zuo et al., 2000, Protein Engineering 13[5]:361-367; U.S. Ser. No. 09/865,198; Shen et al., 2006, J Biol Chem 281[16]:10706-10714; Lu et al., 2005, J Biol Chem 280[20]:19665-19672; PCT/US2005/025472; and Kontermann, 2012 MAbs 4(2):182, all of which are expressly incorporated herein by reference). These formats overcome some of the obstacles of the antibody fragment bispecifics, principally because they contain an Fc region. One significant drawback of these formats is that, because they build new antigen binding sites on top of the homodimeric constant chains, binding to the new antigen is always bivalent.

For many antigens that are attractive as co-targets in a therapeutic bispecific format, the desired binding is monovalent rather than bivalent. For many immune receptors, cellular activation is accomplished by cross-linking of a monovalent binding interaction. The mechanism of cross-linking is typically mediated by antibody/antigen immune complexes, or via effector cell to target cell engagement. For example, the low affinity Fc gamma receptors (FcγRs) such as FcγRIIa, FcγRIIb, and FcγRIIIa bind monovalently to the antibody Fc region. Monovalent binding does not activate cells expressing these FcγRs; however, upon immune complexation or cell-to-cell contact, receptors are cross-linked and clustered on the cell surface, leading to activation. For receptors responsible for mediating cellular killing, for example FcγRIIIa on natural killer (NK) cells, receptor cross-linking and cellular activation occurs when the effector cell engages the target cell in a highly avid format (Bowles & Weiner, 2005, J Immunol Methods 304:88-99, expressly incorporated by reference). Similarly, on B cells the inhibitory receptor FcγRIIb downregulates B cell activation only when it engages into an immune complex with the cell surface B-cell receptor (BCR), a mechanism that is mediated by immune complexation of soluble IgG's with the same antigen that is recognized by the BCR (Heyman 2003, Immunol Lett 88[2]:157-161; Smith and Clatworthy, 2010, Nature Reviews Immunology 10:328-343; expressly incorporated by reference). As another example, CD3 activation of T-cells occurs only when its associated T-cell receptor (TCR) engages antigen-loaded MHC on antigen presenting cells in a highly avid cell-to-cell synapse (Kuhns et al., 2006, Immunity 24:133-139). Indeed nonspecific bivalent cross-linking of CD3 using an anti-CD3 antibody elicits a cytokine storm and toxicity (Perruche et al., 2009, J Immunol 183 [2]:953-61; Chatenoud & Bluestone, 2007, Nature Reviews Immunology 7:622-632; expressly incorporated by reference). Thus for practical clinical use, the preferred mode of CD3 co-engagement for redirected killing of targets cells is monovalent binding that results in activation only upon engagement with the co-engaged target.

Thus while bispecifics generated from antibody fragments suffer biophysical and pharmacokinetic hurdles, a drawback of those built with full length antibody-like formats is that they engage co-target antigens multivalently in the absence of the primary target antigen, leading to nonspecific activation and potentially toxicity. The present invention solves this problem by introducing a novel bispecific format that enables the co-engagement of distinct target antigens.

SUMMARY OF THE INVENTION

Accordingly, in one aspect, the invention provides heterodimeric antibodies comprising a first heavy chain comprising a first Fc domain and a single chain Fv region that binds a first antigen. The heterodimeric antibodies also comprise a second heavy chain comprising a second Fc domain, a first variable heavy chain and a first variable light chain, wherein the first and second Fc domains are different, such that heterodimerization occurs.

In a further aspect, the pIs of the first heavy chain and the second heavy chain are at least 0.5 logs apart.

In an additional aspect, the heterodimeric antibodies of the invention further comprise one or two additional antigen binding domains that can be either or both of an scFv and a Fab.

In a further aspect, the heterodimeric antibodies of the invention comprise heterodimerization variants according to the Figures.

In an additional aspect, the heterodimeric antibodies comprise pI variants in each monomer, with monomer one are ISO(−): I199T/N203D/K274Q/R355Q/N384S/K392N/V397M/Q419E/DEL44 and the pI substitutions in monomer 2 are ISO(+RR): Q196K/I199T/P217R/P228R/N276K.

In additional aspects, the present invention provides heterodimeric antibodies wherein one of the heavy chains comprises a variant selected from the group consisting of S119E, K133E, K133Q, R133E (in case of IgG2-4), R133Q (in case of IgG2-4), T164E, K205E, K205Q, N208D, K210E, K210Q, K274E, K320E, K322E, K326E, K334E, R355E, K392E, Deletion of K447, adding peptide DEDE at the c-terminus, G137E, N203D, K274Q, R355Q, K392N and Q419E, 349A, 349C, 349E, 349I, 349K, 349S, 349T, 349W, 351E, 351K, 354C, 356K, 357K, 364C, 364D, 364E, 364F, 364G, 364H, 364R, 364T, 364Y, 366D, 366K, 366S, 366W, 366Y, 368A, 368E, 368K, 368S, 370C, 370D, 370E, 370G, 370R, 370S, 370V, 392D, 392E, 394F, 394S, 394W, 394Y, 395T, 395V, 396T, 397E, 397S, 397T, 399K, 401K, 405A, 405S, 407T, 407V, 409D, 409E, 411D, 411E, 411K, 439D, 349C/364E, 349K/351K, 349K/351K/394F, 349K/354C, 349K/394F, 349K/394F/401K, 349K/394Y, 349K/401K, 349K/405A, 349T/351E/411E, 349T/394F, 349T/394F/401K, 349T/394F/411E, 349T/405A, 349T/411E, 351E/364D, 351E/364D/405A, 351E/364E, 351E/366D, 351K/364H/401K, 351K/366K, 364D/370G, 364D/394F, 364E/405A, 364E/405S, 364E/411E, 364E/411E/405A, 364H/394F, 364H/401K, 364H/401K/405A, 364H/405A, 364H/405A/411E, 364Y/370R, 370E/411E, 370R/411K, 395T/397S/405A and 397S/405A.

In a further aspect, the invention provides compositions comprising an anti-CD3 variable region having a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430.

In an additional aspect, the invention provides compositions comprising an anti-CD3 variable region having a sequence comprising a vhCDR1 having the sequence T-Y-A-M-Xaa1, wherein Xaa1 is N, S or H (SEQ ID NO:435), a vhCDR2 having the sequence R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436), a vhCDR3 having the sequence H-G-N-F-G-Xaa1 S-Y-V-S-W-F-Xaa2-Y, wherein Xaa1 is N, D or Q and Xaa2 is A or D (SEQ ID NO:437), a vlCDR1 having the sequence Xaa1-S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438), a vlCDR2 having the sequence Xaa1-T-N-Xaa2-R-A-Xaa3, wherein Xaa1 is G or D, Xaa2 is K or N, and Xaa3 is P or S (SEQ ID NO:439) and a vlCDR3 having the sequence Xaa1-L-W-Y-S-N-Xaa2-W-V, wherein Xaa1 is A or L and Xaa2 is L or H (SEQ ID NO:440).

In a further aspect, the anti-CD3 variable region has a sequence selected from the group consisting of: a) a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:412, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:414, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:418, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:421, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:422, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:427 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:428 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:431; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:423, a vlCDR2 having SEQ ID NO:425 and a vlCDR3 having SEQ ID NO:432; a sequence comprising a vhCDR1 having SEQ ID NO:411, a vhCDR2 having SEQ ID NO:413, a vhCDR3 having SEQ ID NO:416, a vlCDR1 having SEQ ID NO:424, a vlCDR2 having SEQ ID NO:425 and a vlCDR3 having SEQ ID NO:432; a sequence comprising a vhCDR1 having SEQ ID NO:412, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:412, a vhCDR2 having SEQ ID NO:414, a vhCDR3 having SEQ ID NO:419, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:419, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:433; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:433 and a sequence comprising a vhCDR1 having SEQ ID NO:411, a vhCDR2 having SEQ ID NO:434, a vhCDR3 having SEQ ID NO:416, a vlCDR1 having SEQ ID NO:420, a vlCDR2 having SEQ ID NO:425 and a vlCDR3 having SEQ ID NO:430.

One preferred aspect provides an anti-CD3 variable region having a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:433.

In an additional aspect, the invention provides amino acid compositions wherein the composition comprises a first amino acid sequence comprising the variable heavy CDRs and a second amino acid sequence comprising the variable light CDRs. In this aspect, the anti-CD3 variable region comprises a variable heavy region and a variable light region selected from the group consisting of: SEQ ID NOs: 5 and 6; SEQ ID NOs: 9 and 10; SEQ ID NOs: 13 and 14; SEQ ID NOs: 17 and 18; SEQ ID NOs: 21 and 22; SEQ ID NOs: 25 and 26; SEQ ID NOs: 29 and 30; SEQ ID NOs: 33 and 34; SEQ ID NOs: 37 and 38; SEQ ID NOs: 41 and 42; SEQ ID NOs: 45 and 46; SEQ ID NOs: 49 and 50; SEQ ID NOs: 53 and 54; SEQ ID NOs: 57 and 58; SEQ ID NOs: 61 and 62; SEQ ID NOs: 65 and 66; SEQ ID NOs: 69 and 70; SEQ ID NOs: 73 and 74; SEQ ID NOs: 77 and 78; SEQ ID NOs: 81 and 82; SEQ ID NOs: 85 and 86; SEQ ID NOs: 89 and 90; SEQ ID NOs: 93 and 94; SEQ ID NOs: 97 and 98; SEQ ID NOs: 101 and 102; SEQ ID NOs: 105 and 106; SEQ ID NOs: 109 and 110; SEQ ID NOs: 113 and 114; SEQ ID NOs: 117 and 118; SEQ ID NOs: 121 and 122; SEQ ID NOs: 125 and 126; SEQ ID NOs: 129 and 130; SEQ ID NOs: 133 and 134; SEQ ID NOs: 137 and 138; SEQ ID NOs: 141 and 142; SEQ ID NOs: 145 and 146; SEQ ID NOs: 149 and 150; SEQ ID NOs: 153 and 154; SEQ ID NOs: 157 and 158; SEQ ID NOs: 161 and 162; SEQ ID NOs: 165 and 166; SEQ ID NOs: 169 and 170; SEQ ID NOs: 173 and 174; SEQ ID NOs: 177 and 178; SEQ ID NOs: 181 and 182; SEQ ID NOs: 185 and 186; SEQ ID NOs: 189 and 190; SEQ ID NOs: 193 and 194; SEQ ID NOs: 197 and 198; SEQ ID NOs: 201 and 202; SEQ ID NOs: 205 and 206; SEQ ID NOs: 209 and 210; SEQ ID NOs: 213 and 214; SEQ ID NOs: 217 and 218; SEQ ID NOs: 221 and 222; SEQ ID NOs: 225 and 226; SEQ ID NOs: 229 and 230; SEQ ID NOs: 233 and 234; SEQ ID NOs: 237 and 238; SEQ ID NOs: 241 and 242; SEQ ID NOs: 245 and 246; SEQ ID NOs: 249 and 250; SEQ ID NOs: 253 and 254; SEQ ID NOs: 257 and 258; SEQ ID NOs: 261 and 262; SEQ ID NOs: 265 and 266; SEQ ID NOs: 269 and 270; SEQ ID NOs: 273 and 274; SEQ ID NOs: 277 and 278; SEQ ID NOs: 281 and 282; SEQ ID NOs: 285 and 286; SEQ ID NOs: 289 and 290; SEQ ID NOs: 293 and 294; SEQ ID NOs: 297 and 298; SEQ ID NOs: 301 and 302; SEQ ID NOs: 305 and 306; SEQ ID NOs: 309 and 310; SEQ ID NOs: 313 and 314; SEQ ID NOs: 317 and 318; SEQ ID NOs: 321 and 322; SEQ ID NOs: 325 and 326; SEQ ID NOs: 329 and 330; SEQ ID NOs: 333 and 334; SEQ ID NOs: 337 and 338; SEQ ID NOs: 341 and 342; SEQ ID NOs: 345 and 346; SEQ ID NOs: 349 and 350; SEQ ID NOs: 353 and 354; SEQ ID NOs: 357 and 358; SEQ ID NOs: 361 and 362; SEQ ID NOs: 365 and 366; SEQ ID NOs: 369 and 370; SEQ ID NOs: 373 and 374; SEQ ID NOs: 377 and 378; SEQ ID NOs: 381 and 382; SEQ ID NOs: 385 and 386; SEQ ID NOs: 389 and 390; SEQ ID NOs: 393 and 394; SEQ ID NOs: 397 and 398; SEQ ID NOs: 401 and 402; SEQ ID NOs: 405 and 406; SEQ ID NOs: 409 and 410.

In some aspects, the invention provides compositions including scFv, and scFv charged linkers. In one embodiment, the charged scFv linker has a positive charge from 3 to 8 and is selected from the group consisting of SEQ ID NO:s 443 to 451. In another embodiment, the charged scFv linker has a negative charge from 3 to 8 and is selected from the group consisting of SEQ ID NO:s 453 to 459.

In a further aspect, the anti-CD3 scFv has a sequence selected from the group consisting of: SEQ ID NO: 4; SEQ ID NO: 8; SEQ ID NO: 12; SEQ ID NO: 16; SEQ ID NO: 20; SEQ ID NO: 24; SEQ ID NO: 28; SEQ ID NO: 32; SEQ ID NO: 36; SEQ ID NO: 40; SEQ ID NO: 44; SEQ ID NO: 48; SEQ ID NO: 52; SEQ ID NO: 56; SEQ ID NO: 60; SEQ ID NO: 64; SEQ ID NO: 68; SEQ ID NO: 72; SEQ ID NO: 76; SEQ ID NO: 80; SEQ ID NO: 84; SEQ ID NO: 88; SEQ ID NO: 92; SEQ ID NO: 96; SEQ ID NO: 100; SEQ ID NO: 104; SEQ ID NO: 108; SEQ ID NO: 112; SEQ ID NO: 116; SEQ ID NO: 120; SEQ ID NO: 124; SEQ ID NO: 128; SEQ ID NO: 132; SEQ ID NO: 136; SEQ ID NO: 140; SEQ ID NO: 144; SEQ ID NO: 148; SEQ ID NO: 152; SEQ ID NO: 156; SEQ ID NO: 160; SEQ ID NO: 164; SEQ ID NO: 168; SEQ ID NO: 172; SEQ ID NO: 176; SEQ ID NO: 180; SEQ ID NO: 184; SEQ ID NO: 188; SEQ ID NO: 192; SEQ ID NO: 196; SEQ ID NO: 200; SEQ ID NO: 204; SEQ ID NO: 208; SEQ ID NO: 212; SEQ ID NO: 216; SEQ ID NO: 220; SEQ ID NO: 224; SEQ ID NO: 228; SEQ ID NO: 232; SEQ ID NO: 236; SEQ ID NO: 240; SEQ ID NO: 244; SEQ ID NO: 248; SEQ ID NO: 252; SEQ ID NO: 256; SEQ ID NO: 260; SEQ ID NO: 264; SEQ ID NO: 268; SEQ ID NO: 272; SEQ ID NO: 276; SEQ ID NO: 280; SEQ ID NO: 284; SEQ ID NO: 288; SEQ ID NO: 292; SEQ ID NO: 296; SEQ ID NO: 300; SEQ ID NO: 304; SEQ ID NO: 308; SEQ ID NO: 312; SEQ ID NO: 316; SEQ ID NO: 320; SEQ ID NO: 324; SEQ ID NO: 328; SEQ ID NO: 332; SEQ ID NO: 336; SEQ ID NO: 340; SEQ ID NO: 344; SEQ ID NO: 348; SEQ ID NO: 352; SEQ ID NO: 356; SEQ ID NO: 360; SEQ ID NO: 364; SEQ ID NO: 368; SEQ ID NO: 372; SEQ ID NO: 376; SEQ ID NO: 380; SEQ ID NO: 384; SEQ ID NO: 388; SEQ ID NO: 392; SEQ ID NO: 396; SEQ ID NO: 400; SEQ ID NO: 404; SEQ ID NO: 408. In some embodiments, the scFv linkers of these sequences can be exchanged for a charged scFv.

In an additional aspect, the invention provides a nucleic acid composition encoding an anti-CD3 variable region comprising a variable heavy region and a variable light region selected from the group consisting of SEQ ID NOs: 5 and 6; SEQ ID NOs: 9 and 10; SEQ ID NOs: 13 and 14; SEQ ID NOs: 17 and 18; SEQ ID NOs: 21 and 22; SEQ ID NOs: 25 and 26; SEQ ID NOs: 29 and 30; SEQ ID NOs: 33 and 34; SEQ ID NOs: 37 and 38; SEQ ID NOs: 41 and 42; SEQ ID NOs: 45 and 46; SEQ ID NOs: 49 and 50; SEQ ID NOs: 53 and 54; SEQ ID NOs: 57 and 58; SEQ ID NOs: 61 and 62; SEQ ID NOs: 65 and 66; SEQ ID NOs: 69 and 70; SEQ ID NOs: 73 and 74; SEQ ID NOs: 77 and 78; SEQ ID NOs: 81 and 82; SEQ ID NOs: 85 and 86; SEQ ID NOs: 89 and 90; SEQ ID NOs: 93 and 94; SEQ ID NOs: 97 and 98; SEQ ID NOs: 101 and 102; SEQ ID NOs: 105 and 106; SEQ ID NOs: 109 and 110; SEQ ID NOs: 113 and 114; SEQ ID NOs: 117 and 118; SEQ ID NOs: 121 and 122; SEQ ID NOs: 125 and 126; SEQ ID NOs: 129 and 130; SEQ ID NOs: 133 and 134; SEQ ID NOs: 137 and 138; SEQ ID NOs: 141 and 142; SEQ ID NOs: 145 and 146; SEQ ID NOs: 149 and 150; SEQ ID NOs: 153 and 154; SEQ ID NOs: 157 and 158; SEQ ID NOs: 161 and 162; SEQ ID NOs: 165 and 166; SEQ ID NOs: 169 and 170; SEQ ID NOs: 173 and 174; SEQ ID NOs: 177 and 178; SEQ ID NOs: 181 and 182; SEQ ID NOs: 185 and 186; SEQ ID NOs: 189 and 190; SEQ ID NOs: 193 and 194; SEQ ID NOs: 197 and 198; SEQ ID NOs: 201 and 202; SEQ ID NOs: 205 and 206; SEQ ID NOs: 209 and 210; SEQ ID NOs: 213 and 214; SEQ ID NOs: 217 and 218; SEQ ID NOs: 221 and 222; SEQ ID NOs: 225 and 226; SEQ ID NOs: 229 and 230; SEQ ID NOs: 233 and 234; SEQ ID NOs: 237 and 238; SEQ ID NOs: 241 and 242; SEQ ID NOs: 245 and 246; SEQ ID NOs: 249 and 250; SEQ ID NOs: 253 and 254; SEQ ID NOs: 257 and 258; SEQ ID NOs: 261 and 262; SEQ ID NOs: 265 and 266; SEQ ID NOs: 269 and 270; SEQ ID NOs: 273 and 274; SEQ ID NOs: 277 and 278; SEQ ID NOs: 281 and 282; SEQ ID NOs: 285 and 286; SEQ ID NOs: 289 and 290; SEQ ID NOs: 293 and 294; SEQ ID NOs: 297 and 298; SEQ ID NOs: 301 and 302; SEQ ID NOs: 305 and 306; SEQ ID NOs: 309 and 310; SEQ ID NOs: 313 and 314; SEQ ID NOs: 317 and 318; SEQ ID NOs: 321 and 322; SEQ ID NOs: 325 and 326; SEQ ID NOs: 329 and 330; SEQ ID NOs: 333 and 334; SEQ ID NOs: 337 and 338; SEQ ID NOs: 341 and 342; SEQ ID NOs: 345 and 346; SEQ ID NOs: 349 and 350; SEQ ID NOs: 353 and 354; SEQ ID NOs: 357 and 358; SEQ ID NOs: 361 and 362; SEQ ID NOs: 365 and 366; SEQ ID NOs: 369 and 370; SEQ ID NOs: 373 and 374; SEQ ID NOs: 377 and 378; SEQ ID NOs: 381 and 382; SEQ ID NOs: 385 and 386; SEQ ID NOs: 389 and 390; SEQ ID NOs: 393 and 394; SEQ ID NOs: 397 and 398; SEQ ID NOs: 401 and 402; SEQ ID NOs: 405 and 406; SEQ ID NOs: 409 and 410.

In some aspects, the nucleic acid composition comprises a first nucleic acid encoding a variant heavy region and a second nucleic acid encoding a variable light region.

In additional aspects, the invention provides nucleic acid compositions encoding scFv amino acid sequence selected from the group consisting of SEQ ID NO: 4; SEQ ID NO: 8; SEQ ID NO: 12; SEQ ID NO: 16; SEQ ID NO: 20; SEQ ID NO: 24; SEQ ID NO: 28; SEQ ID NO: 32; SEQ ID NO: 36; SEQ ID NO: 40; SEQ ID NO: 44; SEQ ID NO: 48; SEQ ID NO: 52; SEQ ID NO: 56; SEQ ID NO: 60; SEQ ID NO: 64; SEQ ID NO: 68; SEQ ID NO: 72; SEQ ID NO: 76; SEQ ID NO: 80; SEQ ID NO: 84; SEQ ID NO: 88; SEQ ID NO: 92; SEQ ID NO: 96; SEQ ID NO: 100; SEQ ID NO: 104; SEQ ID NO: 108; SEQ ID NO: 112; SEQ ID NO: 116; SEQ ID NO: 120; SEQ ID NO: 124; SEQ ID NO: 128; SEQ ID NO: 132; SEQ ID NO: 136; SEQ ID NO: 140; SEQ ID NO: 144; SEQ ID NO: 148; SEQ ID NO: 152; SEQ ID NO: 156; SEQ ID NO: 160; SEQ ID NO: 164; SEQ ID NO: 168; SEQ ID NO: 172; SEQ ID NO: 176; SEQ ID NO: 180; SEQ ID NO: 184; SEQ ID NO: 188; SEQ ID NO: 192; SEQ ID NO: 196; SEQ ID NO: 200; SEQ ID NO: 204; SEQ ID NO: 208; SEQ ID NO: 212; SEQ ID NO: 216; SEQ ID NO: 220; SEQ ID NO: 224; SEQ ID NO: 228; SEQ ID NO: 232; SEQ ID NO: 236; SEQ ID NO: 240; SEQ ID NO: 244; SEQ ID NO: 248; SEQ ID NO: 252; SEQ ID NO: 256; SEQ ID NO: 260; SEQ ID NO: 264; SEQ ID NO: 268; SEQ ID NO: 272; SEQ ID NO: 276; SEQ ID NO: 280; SEQ ID NO: 284; SEQ ID NO: 288; SEQ ID NO: 292; SEQ ID NO: 296; SEQ ID NO: 300; SEQ ID NO: 304; SEQ ID NO: 308; SEQ ID NO: 312; SEQ ID NO: 316; SEQ ID NO: 320; SEQ ID NO: 324; SEQ ID NO: 328; SEQ ID NO: 332; SEQ ID NO: 336; SEQ ID NO: 340; SEQ ID NO: 344; SEQ ID NO: 348; SEQ ID NO: 352; SEQ ID NO: 356; SEQ ID NO: 360; SEQ ID NO: 364; SEQ ID NO: 368; SEQ ID NO: 372; SEQ ID NO: 376; SEQ ID NO: 380; SEQ ID NO: 384; SEQ ID NO: 388; SEQ ID NO: 392; SEQ ID NO: 396; SEQ ID NO: 400; SEQ ID NO: 404; SEQ ID NO: 408. In some embodiments, the scFv linkers of these sequences can be exchanged for a charged scFv.

In an additional aspect, the invention provides host cells comprising the expression vectors and nucleic acids encoding the compositions of the invention.

In a further aspect, the anti-CD3 variable region is not SEQ ID NO:4.

In an additional aspect, the invention provides heterodimeric antibodies comprising: a first heavy chain comprising i) a first Fc domain and a single chain Fv region (scFv) that binds CD3 comprising a vhCDR1 having the sequence T-Y-A-M-Xaa1, wherein Xaa1 is N, S or H (SEQ ID NO:435), a vhCDR2 having the sequence R-I-R-S-K-Xaa1-N-Xaa2-Y-A-T-Xaa3-Y-Y-A-Xaa4-S-V-K-G, wherein Xaa1 is Y or A, Xaa2 is N or S, Xaa3 is Y or A and Xaa4 is D or A (SEQ ID NO:436), a vhCDR3 having the sequence H-G-N-F-G-Xaa1S-Y-V-S-W-F-Xaa2-Y, wherein Xaa1 is N, D or Q and Xaa2 is A or D (SEQ ID NO:437), a vlCDR1 having the sequence Xaa1 S-S-T-G-A-V-T-Xaa2-Xaa3-Xaa4-Y-A-N, wherein Xaa1 is G, R or K, Xaa2 is T or S, Xaa3 is S or G and Xaa4 is N or H, (SEQ ID NO:438), a vlCDR2 having the sequence Xaa1-T-N-Xaa2-R-A-Xaa3, wherein Xaa1 is G or D, Xaa2 is K or N, and Xaa3 is P or S (SEQ ID NO:439) and a vlCDR3 having the sequence Xaa1-L-W-Y-S-N-Xaa2-W-V, wherein Xaa1 is A or L and Xaa2 is L or H (SEQ ID NO:440). The heterodimeric antibody also comprises a second heavy chain comprising a second Fc domain, a first variable heavy chain and a first variable light chain, wherein said first and second Fc domains are different. In this aspect, the anti-CD3 variable region can have a sequence selected from the group consisting of: a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:412, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:414, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:418, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:421, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:422, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:427 and a vlCDR3 having SEQ ID NO:430; sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:428 and a vlCDR3 having SEQ ID NO:430; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:431; a sequence comprising a vhCDR1 having SEQ ID NO:411, a vhCDR2 having SEQ ID NO:413, a vhCDR3 having SEQ ID NO:416, a vlCDR1 having SEQ ID NO:423, a vlCDR2 having SEQ ID NO:425 and a vlCDR3 having SEQ ID NO:432; a sequence comprising a vhCDR1 having SEQ ID NO:411, a vhCDR2 having SEQ ID NO:413, a vhCDR3 having SEQ ID NO:416, a vlCDR1 having SEQ ID NO:424, a vlCDR2 having SEQ ID NO:425 and a vlCDR3 having SEQ ID NO:432; a sequence comprising a vhCDR1 having SEQ ID NO:412, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:412, a vhCDR2 having SEQ ID NO:414, a vhCDR3 having SEQ ID NO:419, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:415, a vhCDR3 having SEQ ID NO:416, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:419, a vlCDR1 having SEQ ID NO:420, a vlCDR2 having SEQ ID NO:425 and a vlCDR3 having SEQ ID NO:430; a sequence comprising a vhCDR1 having SEQ ID NO:411, a vhCDR2 having SEQ ID NO:413, a vhCDR3 having SEQ ID NO:417, a vlCDR1 having SEQ ID NO:420, a vlCDR2 having SEQ ID NO:425 and a vlCDR3 having SEQ ID NO:433; a sequence comprising a vhCDR1 having SEQ ID NO:411, a vhCDR2 having SEQ ID NO:413, a vhCDR3 having SEQ ID NO:416, a vlCDR1 having SEQ ID NO:420, a vlCDR2 having SEQ ID NO:425 and a vlCDR3 having SEQ ID NO:433 and a sequence comprising a vhCDR1 having SEQ ID NO:411, a vhCDR2 having SEQ ID NO:434, a vhCDR3 having SEQ ID NO:416, a vlCDR1 having SEQ ID NO:420, a vlCDR2 having SEQ ID NO:425 and a vlCDR3 having SEQ ID NO:430.

In some aspects, the composition comprises a first amino acid sequence comprising the variable heavy CDRs and a second amino acid sequence comprising the variable light CDRs.

In one aspect of the Triple F format, the invention provides Triple F heterodimeric antibodies comprising an anti-CD3 variable region comprises a variable heavy region and a variable light region selected from the group consisting of: SEQ ID NOs: 5 and 6; SEQ ID NOs: 9 and 10; SEQ ID NOs: 13 and 14; SEQ ID NOs: 17 and 18; SEQ ID NOs: 21 and 22; SEQ ID NOs: 25 and 26; SEQ ID NOs: 29 and 30; SEQ ID NOs: 33 and 34; SEQ ID NOs: 37 and 38; SEQ ID NOs: 41 and 42; SEQ ID NOs: 45 and 46; SEQ ID NOs: 49 and 50; SEQ ID NOs: 53 and 54; SEQ ID NOs: 57 and 58; SEQ ID NOs: 61 and 62; SEQ ID NOs: 65 and 66; SEQ ID NOs: 69 and 70; SEQ ID NOs: 73 and 74; SEQ ID NOs: 77 and 78; SEQ ID NOs: 81 and 82; SEQ ID NOs: 85 and 86; SEQ ID NOs: 89 and 90; SEQ ID NOs: 93 and 94; SEQ ID NOs: 97 and 98; SEQ ID NOs: 101 and 102; SEQ ID NOs: 105 and 106; SEQ ID NOs: 109 and 110; SEQ ID NOs: 113 and 114; SEQ ID NOs: 117 and 118; SEQ ID NOs: 121 and 122; SEQ ID NOs: 125 and 126; SEQ ID NOs: 129 and 130; SEQ ID NOs: 133 and 134; SEQ ID NOs: 137 and 138; SEQ ID NOs: 141 and 142; SEQ ID NOs: 145 and 146; SEQ ID NOs: 149 and 150; SEQ ID NOs: 153 and 154; SEQ ID NOs: 157 and 158; SEQ ID NOs: 161 and 162; SEQ ID NOs: 165 and 166; SEQ ID NOs: 169 and 170; SEQ ID NOs: 173 and 174; SEQ ID NOs: 177 and 178; SEQ ID NOs: 181 and 182; SEQ ID NOs: 185 and 186; SEQ ID NOs: 189 and 190; SEQ ID NOs: 193 and 194; SEQ ID NOs: 197 and 198; SEQ ID NOs: 201 and 202; SEQ ID NOs: 205 and 206; SEQ ID NOs: 209 and 210; SEQ ID NOs: 213 and 214; SEQ ID NOs: 217 and 218; SEQ ID NOs: 221 and 222; SEQ ID NOs: 225 and 226; SEQ ID NOs: 229 and 230; SEQ ID NOs: 233 and 234; SEQ ID NOs: 237 and 238; SEQ ID NOs: 241 and 242; SEQ ID NOs: 245 and 246; SEQ ID NOs: 249 and 250; SEQ ID NOs: 253 and 254; SEQ ID NOs: 257 and 258; SEQ ID NOs: 261 and 262; SEQ ID NOs: 265 and 266; SEQ ID NOs: 269 and 270; SEQ ID NOs: 273 and 274; SEQ ID NOs: 277 and 278; SEQ ID NOs: 281 and 282; SEQ ID NOs: 285 and 286; SEQ ID NOs: 289 and 290; SEQ ID NOs: 293 and 294; SEQ ID NOs: 297 and 298; SEQ ID NOs: 301 and 302; SEQ ID NOs: 305 and 306; SEQ ID NOs: 309 and 310; SEQ ID NOs: 313 and 314; SEQ ID NOs: 317 and 318; SEQ ID NOs: 321 and 322; SEQ ID NOs: 325 and 326; SEQ ID NOs: 329 and 330; SEQ ID NOs: 333 and 334; SEQ ID NOs: 337 and 338; SEQ ID NOs: 341 and 342; SEQ ID NOs: 345 and 346; SEQ ID NOs: 349 and 350; SEQ ID NOs: 353 and 354; SEQ ID NOs: 357 and 358; SEQ ID NOs: 361 and 362; SEQ ID NOs: 365 and 366; SEQ ID NOs: 369 and 370; SEQ ID NOs: 373 and 374; SEQ ID NOs: 377 and 378; SEQ ID NOs: 381 and 382; SEQ ID NOs: 385 and 386; SEQ ID NOs: 389 and 390; SEQ ID NOs: 393 and 394; SEQ ID NOs: 397 and 398; SEQ ID NOs: 401 and 402; SEQ ID NOs: 405 and 406; SEQ ID NOs: 409 and 410.

In one aspect of the Triple F format, the invention provides Triple F heterodimeric antibodies comprising an anti-CD3 scFv having a sequence selected from the group consisting of: SEQ ID NO: 4; SEQ ID NO: 8; SEQ ID NO: 12; SEQ ID NO: 16; SEQ ID NO: 20; SEQ ID NO: 24; SEQ ID NO: 28; SEQ ID NO: 32; SEQ ID NO: 36; SEQ ID NO: 40; SEQ ID NO: 44; SEQ ID NO: 48; SEQ ID NO: 52; SEQ ID NO: 56; SEQ ID NO: 60; SEQ ID NO: 64; SEQ ID NO: 68; SEQ ID NO: 72; SEQ ID NO: 76; SEQ ID NO: 80; SEQ ID NO: 84; SEQ ID NO: 88; SEQ ID NO: 92; SEQ ID NO: 96; SEQ ID NO: 100; SEQ ID NO: 104; SEQ ID NO: 108; SEQ ID NO: 112; SEQ ID NO: 116; SEQ ID NO: 120; SEQ ID NO: 124; SEQ ID NO: 128; SEQ ID NO: 132; SEQ ID NO: 136; SEQ ID NO: 140; SEQ ID NO: 144; SEQ ID NO: 148; SEQ ID NO: 152; SEQ ID NO: 156; SEQ ID NO: 160; SEQ ID NO: 164; SEQ ID NO: 168; SEQ ID NO: 172; SEQ ID NO: 176; SEQ ID NO: 180; SEQ ID NO: 184; SEQ ID NO: 188; SEQ ID NO: 192; SEQ ID NO: 196; SEQ ID NO: 200; SEQ ID NO: 204; SEQ ID NO: 208; SEQ ID NO: 212; SEQ ID NO: 216; SEQ ID NO: 220; SEQ ID NO: 224; SEQ ID NO: 228; SEQ ID NO: 232; SEQ ID NO: 236; SEQ ID NO: 240; SEQ ID NO: 244; SEQ ID NO: 248; SEQ ID NO: 252; SEQ ID NO: 256; SEQ ID NO: 260; SEQ ID NO: 264; SEQ ID NO: 268; SEQ ID NO: 272; SEQ ID NO: 276; SEQ ID NO: 280; SEQ ID NO: 284; SEQ ID NO: 288; SEQ ID NO: 292; SEQ ID NO: 296; SEQ ID NO: 300; SEQ ID NO: 304; SEQ ID NO: 308; SEQ ID NO: 312; SEQ ID NO: 316; SEQ ID NO: 320; SEQ ID NO: 324; SEQ ID NO: 328; SEQ ID NO: 332; SEQ ID NO: 336; SEQ ID NO: 340; SEQ ID NO: 344; SEQ ID NO: 348; SEQ ID NO: 352; SEQ ID NO: 356; SEQ ID NO: 360; SEQ ID NO: 364; SEQ ID NO: 368; SEQ ID NO: 372; SEQ ID NO: 376; SEQ ID NO: 380; SEQ ID NO: 384; SEQ ID NO: 388; SEQ ID NO: 392; SEQ ID NO: 396; SEQ ID NO: 400; SEQ ID NO: 404; SEQ ID NO: 408. In this aspect, the scFv linker can be standard or a charged scFv linker as described herein.

In a further aspect, the invention provides Triple F format heterodimeric antibodies comprising a first heavy chain comprising i) a first Fc domain and a single chain Fv region (scFv) that binds a first antigen, wherein the scFv comprises a charged scFv linker; and a second heavy chain comprising: a second Fc domain; a first variable heavy chain; and a first variable light chain. The charged scFv linker can have a positive charge from 3 to 8 and is selected from the group consisting of SEQ ID NO:s 443 to 451 or a negative charge from 3 to 8 and is selected from the group consisting of SEQ ID NO:s 453 to 459.

In an additional embodiment, Triple F format heterodimeric antibodies with charged scFv linkers can also include first and second Fc domains each comprising at least one heterodimerization variant as described herein.

In a further aspect, the Triple F format heterodimeric antibodies comprises a first heavy chain comprising i) a first Fc domain, and ii) a single chain Fv region (scFv) that binds a first antigen; and a second heavy chain comprising i) a second Fc domain, a first variable heavy chain; and a first variable light chain; wherein said first and second Fc domains comprise a variant set selected from the variants listed in FIG. 9. These include sets selected from the group consisting of: L368D/K370S and S364K; L368D/K370S and S364K/E357L; L368D/K370S and S364K/E357Q; T411E/K360E/Q362E and D401K; L368E/K370S and S364K; K370S and S364K/E357Q; and K370S and S364K/E357Q. Additional heterodimerization variants can be independently and optionally included and selected from variants outlined in any of FIG. 9A, 9B, 9C or 33. These compositions can further comprise ablation variants, pI variants, charged variants, isotypic variants, etc.

In a further aspect, the invention provides Triple F format heterodimeric antibodies comprising: a) a first heavy chain comprising i) a first Fc domain and ii) a single chain Fv region (scFv) that binds a first antigen; and a second heavy chain comprising: i) a second Fc domain; ii) a first variable heavy chain; and iii) a first variable light chain; wherein one of the Fc domains comprises one or more Fcγreceptor ablation variants. These ablation variants are depicted in FIG. 33, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. Additional heterodimerization variants can be independently and optionally added.

In an additional aspect, the invention provides Triple F format heterodimeric antibodies comprising: a first heavy chain comprising: i) a first Fc domain; and ii) a single chain Fv region that binds a first antigen; and a second heavy chain comprising: i) a second Fc domain; ii) a first variable heavy chain; and iii) a first variable light chain; wherein the first and second Fc domains comprise a set of variants as shown in Figures, 9, 32 or 33.

In a further aspect, the invention provides dual scFv heterodimeric antibodies comprising a first heavy chain comprising: i) a first Fc domain; and ii) a first single chain Fv region (scFv) that binds a first antigen; wherein the first scFv comprises a first charged scFv linker; and a second heavy chain comprising: i) a second Fc domain; ii) a second scFv that binds a second antigen. IN this aspect, the first charged scFv linker has a positive charge from 3 to 8 and is selected from the group consisting of SEQ ID NO:s 443 to 451 or a negative charge from 3 to 8 and is selected from the group consisting of SEQ ID NO:s 453 to 459.

In an additional aspect, both scFv linkers are charged and they have opposite charges.

In a further aspect, the invention provides methods of making a heterodimeric antibody comprising: a) providing a first nucleic acid encoding a first heavy chain comprising: i) a first heavy chain comprising: a first Fc domain; and a single chain Fv region (scFv) that binds a first antigen; wherein said scFv comprises a charged linker; and providing a second nucleic acid encoding a second heavy chain comprising: a second Fc domain; a first variable heavy chain; and providing a third nucleic acid comprising a light chain; expressing said first, second and third nucleic acids in a host cell to produce a first, second and third amino acid sequence, respectively; loading said first, second and third amino acid sequences onto an ion exchange column; and collecting the heterodimeric fraction.

The present invention describes methods for generating the novel compositions of the invention. The present invention describes purification methods for the immunogloublins herein, particularly methods for separating heterodimeric and homodimeric protein species. Also described are methods of testing the immunoglobulins herein, including in vitro and in vitro experiments.

The present invention provides isolated nucleic acids encoding the novel immunoglobulin compositions described herein. The present invention provides vectors comprising said nucleic acids, optionally, operably linked to control sequences. The present invention provides host cells containing the vectors, and methods for producing and optionally recovering the immunoglobulin compositions.

The present invention provides compositions comprising immunoglobulin polypeptides described herein, and a physiologically or pharmaceutically acceptable carrier or diluent.

The present invention contemplates therapeutic and diagnostic uses for the immunoglobulin polypeptides disclosed herein.

BRIEF DESCRIPTION OF THE DRAWINGS

FIG. 1A shows a scFv-Fc format. FIG. 1C depicts a more standard bispecific format, also utilizing the pI variants of the invention (and optionally and independently the other heterodimerization variants). FIG. 1B shows the "triple F" format (sometimes also referred to as the "bottle-opener" configuration; (and optionally and independently the other heterodimerization variants).

FIG. 2A shows a "triple F" configuration with another scFv attached to the Fab monomer (this one, along with FIG. 2D, has a greater molecular weight differential as well). FIG. 2B depicts a "triple F" with another scFv attached to the scFv monomer. FIG. 2C depicts a "three scFv" format. FIG. 2D depicts an additional Fab attached to the Fab monomer. FIG. 2E depicts a Fab hooked to one of the scFv monomers.

FIG. 3A shows a "Fab-Fv" format with binding to two different antigens, with FIG. 3B depicting the "Fab-Fv" format with binding to a single antigen (e.g. bivalent binding to antigen 1). FIGS. 3C and 3D depicts a "Fv-Fab" format with similar bivalent or monovalent additional antigen binding. FIG. 3E depicts one monomer with a CH1-CL attached to the second scFv.

FIGS. 4A and 4B depict novel steric variants. As will be understood by those in the art, the first column of each table represents "corresponding" monomer pairs; that is, monomer 1 has 405A and the corresponding steric variant is 394F. It is important to note that in the context of the asymmetrical triple F format, either monomer can have either variant. That is, the scFv monomer can be monomer 1 or monomer 2. Again, these sets can be optionally and independently combined with other steric variants as well as other heterodimerization variants including charge pairs, isotypic variants, isosteric variants, pI variants, etc, as long as some "strandedness" is maintained. In addition, the "monomer" refers to the Fc domains; that is, in the triple F format, one monomer is the scFv construct and the other monomer is the Fab construct, despite the fact that there are actually two amino acid sequences that comprise the Fab construct (the heavy and light chains). show a number of suitable steric or "skew" variants of use in the present invention. FIG. 4 depicts a number of steric variants that can be used alone or in combination with pI variants (as is true of all the variants in FIG. 9); however, as will be appreciated by those in the art, if there are pI variants, the "strandedness" of the pI variants and steric variants should be maintained. That is, if for example the pI variants S364K/E357Q (monomer 1) and L368D/K370S (monomer 2) are to be combined with FIG. 29C variants, the pI of the steric variants should be considered and assigned to the correct monomer. That is, steric variants that alter charge (T411E) for example, are added to the "negative" monomer.

FIGS. 5A and 5B depicts heterodimerization variants that find particular use in the present invention.

FIG. 6 depicts novel pI heterodimerization variants of particular use in the creation of heterodimeric proteins. As will be understood by those in the art, the first row of each table represents "corresponding" monomer pairs or sets. Note that the I199T and V397M variants are "neutral" (e.g. not for the purposes of altering pI of one of the monomers). Rather, they contribute to the reduction of immunogenicity by helping preserve a close epitope; e.g. I199T follows pI variants N203D or Q196K, and V397M follows K392N. Thus these two variants can optionally and independently be removed from any of the sequences above.

FIGS. 7A and 7B. Amino acid sequences for an anti-CD19 Fab×anti-CD3 scFv "triple F" embodiment, showing the HC-Fab sequence, the HC-scFv sequence, and the light chain. Amino acid substitutions made to allow for efficient purification of the desired "triple F" heterodimer over the undesired dual scFv-Fc and mAb homodimers are underlined.

FIG. 8. Amino acid sequences for the humanized anti-CD3 variable regions finding particular use in the invention (with CDRs underlined).

In FIG. 9A, the ion exchange purification of the desired "triple F" heterodimer from the undesired dual scFv-Fc and mAb homodimers is shown. The purity of the "triple F" fraction was checked by IEF gel, shown in FIG. 9B. Finally, SEC was used to confirm the homogenous size of the "triple F" product (see FIG. 9C).

In FIG. 11A, the ion exchange purification of the desired "triple F" heterodimer from the undesired dual scFv-Fc and mAb homodimers is shown. The purity of the "triple F" fraction was checked by IEF gel, shown in FIG.

11B. Finally, SEC was used to confirm the homogenous size of the "triple F" product (see FIG. 11C).

Figure 12:
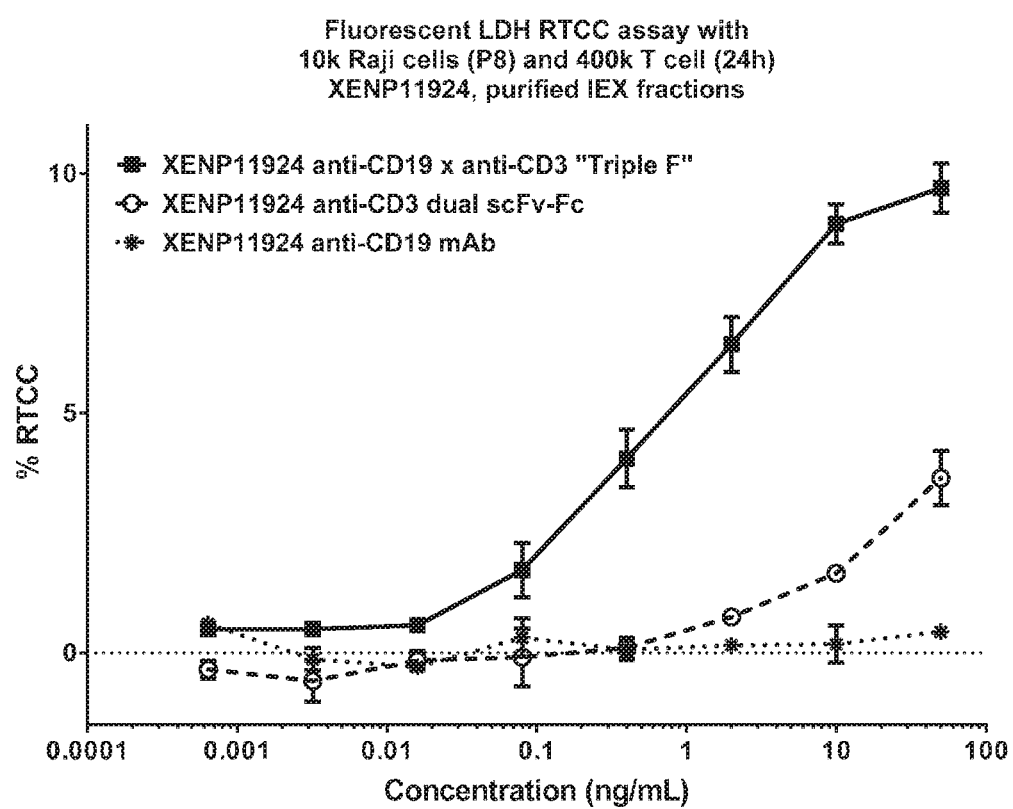

FIG. 12. XENP11924, anti-CD19 Fab×anti-CD3 scFv "triple F" bispecific, potently recruits T cells for the killing of the Raji tumor cell line.

FIG. 13. Amino acid sequences for the anti-CD38 Fab× anti-CD3 scFv "triple F" embodiment, showing the HC-Fab sequence, the HC-scFv sequence, and the light chain. Amino acid substitutions made to allow for efficient purification of the desired "triple F" heterodimer over the undesired dual scFv-Fc and mAb homodimers are underlined.

FIGS. 14A, 14B and 14C. The production of XENP11925, a "triple F" bispecific with an anti-CD38 Fab and anti-CD3 scFv. In FIG. 14A, the ion exchange purification of the desired "triple F" heterodimer from the undesired dual scFv-Fc and mAb homodimers is shown. The purity of the "triple F" fraction was checked by IEF gel, shown in FIG. 14B. Finally, SEC was used to confirm the homogenous size of the "triple F" product (see FIG. 14C).

FIG. 15. XENP11925, anti-CD38 Fab×anti-CD3 scFv "triple F" bispecific, potently recruits T cells for the killing of the RPMI8226 tumor cell line.

FIGS. 16A and 16B Amino acid sequences for embodiments of the anti-CD19 Fab×anti-CD3 scFv "triple F" bispecific, showing the HC-Fab sequence, the HC-scFv sequence, and the light chain for each bispecific Amino acid substitutions made to "skew" the formation toward desired "triple F" heterodimer over undesired dual scFv-Fc and mAb homodimers are underlined.

Figure 17:
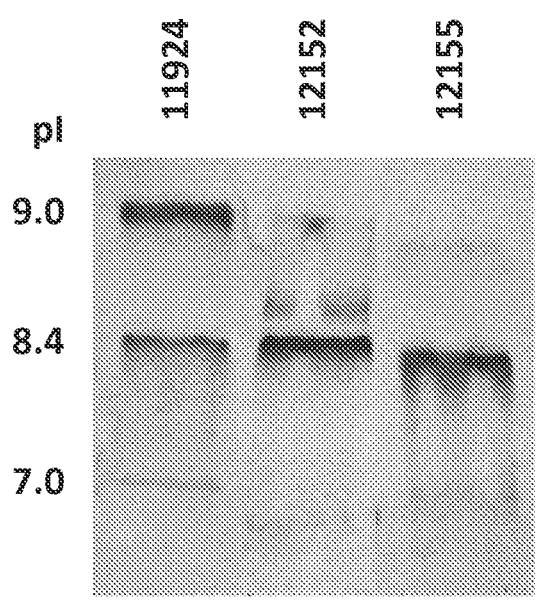

FIG. 17. Isoelectric focusing (IEF) gel providing analysis of various "triple F" bispecifics. The desired "triple F" heterodimer has an apparent pI of 8.4 (middle band). Note the increase in heterodimer yield for XENP12152 and XENP12155.

Figure 18:
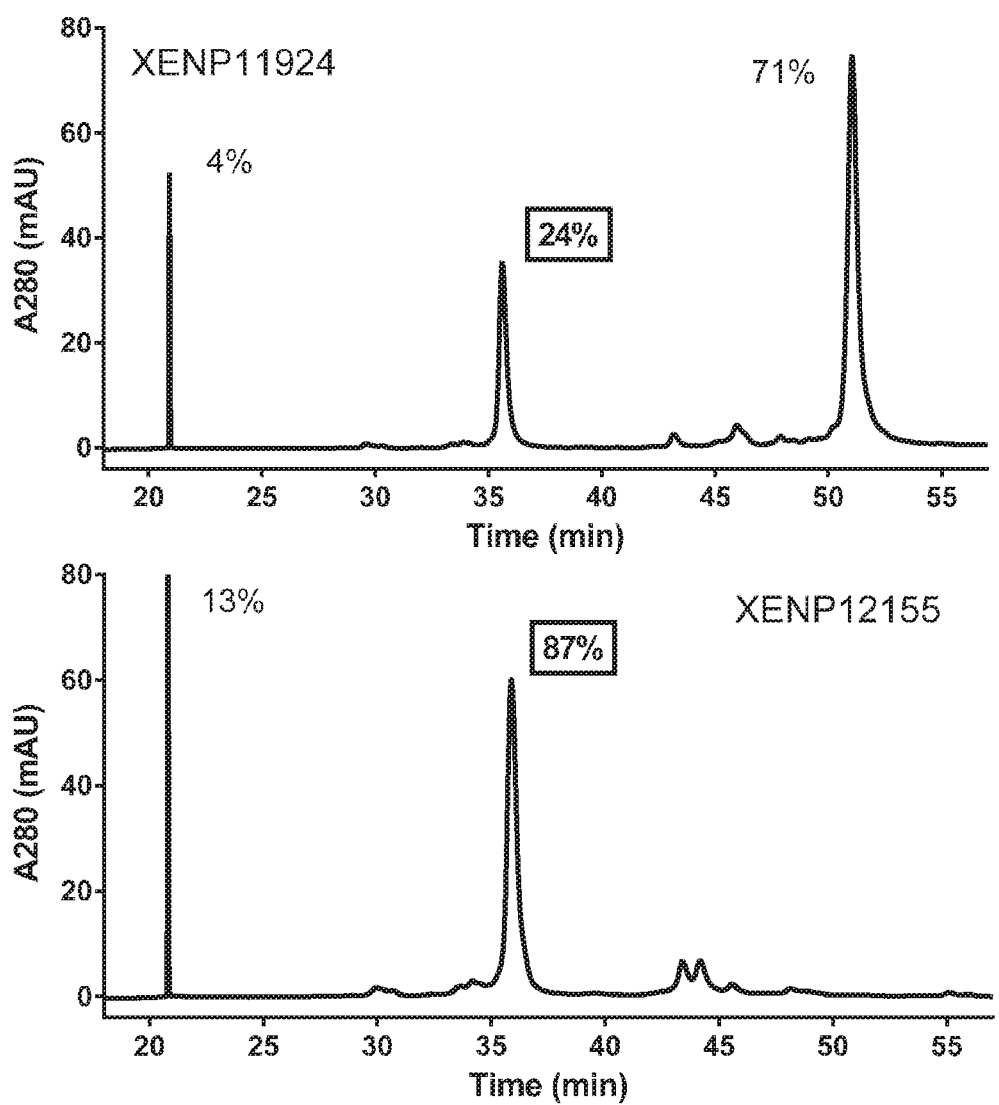

FIG. 18. Analytical ion exchange chromatography providing analysis of various "triple F" bispecifics. Yield of the desired "triple F" heterodimer is boxed. Note the increase in heterodimer yield for XENP12155.

FIG. 19 shows the literature pIs of the 20 amino acids. It should be noted that the listed pIs are calculated as free amino acids; the actual pI of any side chain in the context of a protein is different, and thus this list is used to show pI trends and not absolute numbers for the purposes of the invention.

FIGS. 20A-20F. Data table of exemplary pI-engineered variants listing:

| | |
|---|---|
| XenP# | the internal reference number |
| Name (HC) | heavy chain sequence designation |
| SEQ ID NO (HC) | corresponding SEQ ID NO of the heavy chain sequence |
| Name (LC) | light chain sequence designation |
| SEQ ID NO (LC) | corresponding SEQ ID NO of the light chain sequence |
| Calc. pI | calculated pI value for the entire antibody sequence, including heavy and light chain Fv + constant domains, with the Fv of bevacizumab and the constant domains as defined in the table |
| #KR | number of Lys or Arg residues in IgG1 with the Fv of bevacizumab and the constant domains as defined in the table |
| Delta KR (vs. WT) | change in the number of Lys or Arg residues relative to IgG1 wild-type sequence of bevacizumab |
| #DE | number of Asp or Glu residues in IgG1 with the Fv of bevacizumab and the constant domains as defined in the table |
| Delta DE (vs. WT) | change in the number of Asp or Glu acid residues relative to IgG1 wild-type sequence of bevacizumab |
| Charge state | derived from the total number of Lys and Arg minus the total number of Asp and Glu residues, assuming a pH of 7 |
| # HC Mutations vs IgG1 | number of mutations in the heavy chain constant domain as compared to IgG1 |
| # LC Mutations vs IgG1 | number of mutations in the light chain constant domain as compared to IgG1 |
| Total # of Mutations | total number of mutations in the heavy chain and light chain constant domains as compared to IgG1 |

It should be noted that FIG. 20 has SEQ ID NO:s that are associated with the sequence listing filed in U.S. Ser. No. 13/648,951, and are hereby expressly incorporated by reference.

FIGS. 21A, 21B and 21C. depicts a number of pI variants that can additionally find use in the present invention, which is a list of all possible reduced pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIG. 22. List of all possible increased pI variants created from isotypic substitutions of IgG1-4. Shown are the pI values for the three expected species as well as the average delta pI between the heterodimer and the two homodimer species present when the variant heavy chain is transfected with IgG1-WT heavy chain.

FIGS. 23A and 23B is an additional list of potential heterodimerization variants for use in the present invention.

FIG. 24 depicts a matrix of possible combinations of heterodimerization formats, heterodimerization variants (separated into pI variants and steric variants (which includes charge pair variants), Fc variants, FcRn variants and combinations. Legend A are suitable FcRn variants: 434A, 434S, 428L, 308F, 259I, 428L/434S, 259I/308F, 436I/428L, 436I or V/434S, 436V/428L, 252Y, 252Y/254T/ 256E and 259I/308F/428L. That is, the Triple F format of FIG. 1B can have any of these FcRn variants. For clarity, as each heavy chain is different, FcRn variants (as well as the Fc variants) can reside on one or both monomers. Legend B are suitable Fc variants: 236A, 239D, 239E, 332E, 332D, 239D/332E, 267D, 267E, 328F, 267E/328F, 236A/332E, 239D/332E/330Y, 239D, 332E/330L, 236R, 328R, 236R/ 328R, 236N/267E, 243L, 298A and 299T. (Note, additional suitable Fc variants are found in FIG. 41 of US 2006/ 0024298, the figure and legend of which are hereby incorporated by reference in their entirety). Legend C are suitable pI variants, and these, for brevity are imported from FIG. 23, again with the understanding that there is a "strandedness" to pI variants. Legend D are suitable steric variants (including charge pair variants); again, for brevity are imported from FIG. 21, again with the understanding that there is a "strandedness" to steric variants. Legend E reflects the following possible combinations, again, with each variant being independently and optionally combined from the appropriate source Legend: 1) pI variants plus FcRn variants; 2) pI variants plus Fc variants; 3) pI variants plus FcRn variants plus Fc variants; 4) steric variants plus FcRn variants; 5) steric variants plus Fc variants; 6) steric variants plus FcRn variants plus Fc variants; 7) pI variants plus steric variants plus FcRn variants; 8) pI variants plus steric variants plus Fc variants; 9) pI variants plus steric variants plus FcRn variants plus Fc variants; and 10) pI variants plus steric variants.

FIGS. 25A, 25B and 25C depict stability-optimized, humanized anti-CD3 variant scFvs. Substitutions are given relative to the H1_L1.4 scFv sequence. Amino acid numbering is Kabat numbering.

FIGS. 26A to 26YY depict the amino acid sequences of stability-optimized, humanized anti-CD3 variant scFvs, variable heavy and variable light sequences. (Note also that the first sequence is the histidine tagged version for ease of purification). CDRs are underlined. It should be understood that the increased stability of the optimized variable and optimized light chains (as well as the scFv chains) can be attributed to framework regions as well as the CDRs. Thus, it should be understood that the disclosure of the entire variable region includes the disclosure of the framework regions, although they are not separately numbered. In addition, the scFv linkers are shown in grey. Each scFv linker can be replaced with a charged scFv linker as depicted in FIG. 31. That is, any charged scFv linker, whether positive or negative, including those depicted in FIG. 31, can be substituted for the highlighted region in FIGS. 26A to 26YY.

FIGS. 27A and 27B show yields after Ni-NTA purification and melting temperatures (Tm) as determined by DSF (Differential Scanning Fluorimetry) of stability-optimized, humanized anti-CD3 variant scFvs. Similar DSF stability measurements for the I2C anti-CD3 variable region in a comparable scFv format gave a Tm of 59° C.

FIGS. 28A and 28B show fold improvement (relative to H1_L1.4 scFv) in cell surface binding affinities (IC50) of stability-optimized, humanized anti-CD3 variant scFvs as determined in a competitive binding experiment using purified human T cells from PBMCs.

FIG. 29. Figure depicts the sequence of human CD3.

FIGS. 30A to 30I depict a collation of all the CD3 vhCDR1-3 and vlCDR1-3 sequences useful in the present invention.

FIG. 31 depicts suitable positive and negatively charged scFv linkers. A single prior art scFv linker with a single charge is references as "Whitlow", from Whitlow et al., Protein Engineering 6(8):989-995 (1993). It should be noted that this linker was used for reducing aggregation and enhancing proteolytic stability in scFvs.

FIGS. 32A, 32B and 32C depict additional steric (e.g. including charge variants and "skewing" variants, as "monomer 1" and "monomer 2". The figure depicts these additional variants in the context of ISO(−) monomer 1 and ISO(+RR) monomer 2, although this is optional.

FIG. 33 depicts a number of suitable "knock out" ("KO") variants to reduce binding to some or all of the FcγR receptors. As is true for many if not all variants herein, these KO variants can be independently and optionally combined, both within the set described in FIG. 35 and with any heterodimerization variants outlined herein, including steric and pI variants. For example, E233P/L234V/L235A/G236del can be combined with any other single or double variant from the list. In addition, while it is preferred in some embodiments that both monomers contain the same KO variants, it is possible to combine different KO variants on different monomers, as well as have only one monomer comprise the KO variant(s). Reference is also made to the Figures and Legends of U.S. Ser. No. 61/913,870, all of which is expressly incorporated by reference in its entirety as it relates to "knock out" or "ablation" variants.

DETAILED DESCRIPTION OF THE INVENTION

Figure 1:
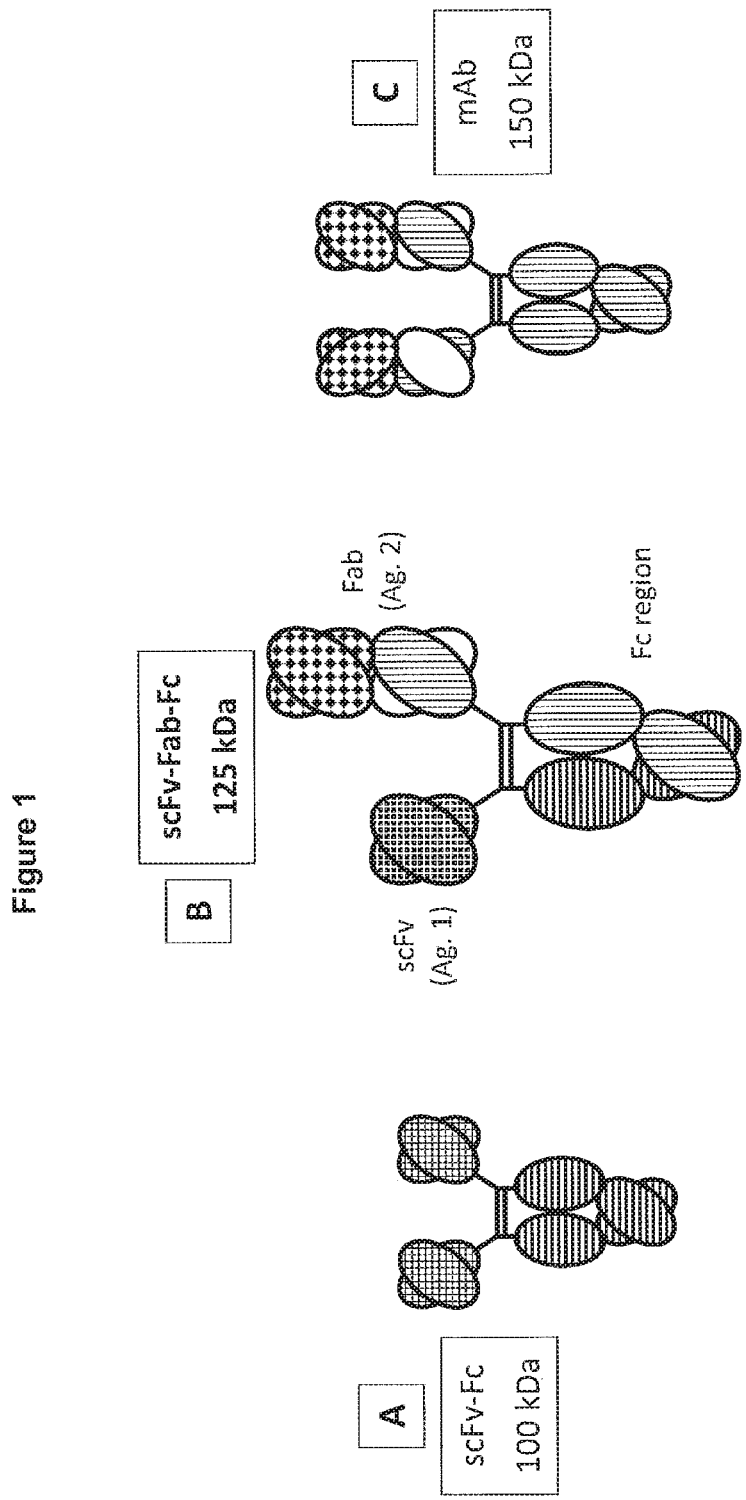
FIGS. 1A to 1C. Illustration of the "triple F" format for bispecific immunoglobulins.

FIGS. 1-76 of U.S. Ser. No. 61/593,846 and the associated legends and discussion in the specification are hereby incorporated by reference.

U.S. Ser. Nos. 61/778,157 and 61/818,410 are specifically and completely incorporated by reference in its entirety, particularly the Figures and Legends therein.

I. OVERVIEW

The present invention is directed to novel constructs to provide bispecific antibodies (or, as discussed below, trispecific or tetraspecific antibodies can also be made). An ongoing problem in antibody technologies is the desire for "bispecific" (and/or multispecific) antibodies that bind to two (or more) different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B). However, a major obstacle in the formation of multispecific antibodies is the difficulty in purifying the heterodimeric antibodies away from the homodimeric antibodies and/or biasing the formation of the heterodimer over the formation of the homodimers.

The present invention is generally directed to the creation of heterodimeric proteins such as antibodies that can co-engage antigens in several ways, relying on amino acid variants in the constant regions that are different on each chain to promote heterodimeric formation and/or allow for ease of purification of heterodimers over the homodimers.

Thus, the present invention is directed to novel immunoglobulin compositions that co-engage at least a first and a second antigen. First and second antigens of the invention are herein referred to as antigen-1 and antigen-2 respectively. One heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener (see Figure). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

There are a number of mechanisms that can be used to generate the heterodimers of the present invention. In addition, as will be appreciated by those in the art and described more fully below, these mechanisms can be combined to ensure high heterodimerization.

One mechanism is generally referred to in the art as "knobs and holes" ("KIH"), or sometimes herein as "skew" variants, referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R. (Note the 220 mutation is to remove a cysteine no longer needed for heavy and light chain disulfide formation, as more fully described below).

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, the "triple F" format also allows separation on the basis of size. As is further outlined below, it is also possible to "skew" the formation of heterodimers over homodimers, as is generally outlined below. Thus, a combination of steric heterodimerization variants and pI or charge pair variants find particular use in the invention. Additionally, as more fully outlined below, the scFv monomer of the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide the use of skew variants with charged scFv linkers as well (and combinations of Fc, FcRn and KO variants).

In the present invention that utilizes pI as a separation mechanism to create the heterodimeric Triple F format, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine). A number of these variants are shown in the Figures.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A−+B or wt A−−B), or by increasing one region and decreasing the other region (A+−B− or A−B+). It should be noted that in this discussion it does not matter which monomer comprises the scFv and which the Fab.

Thus, in general, a component of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Figure 11:
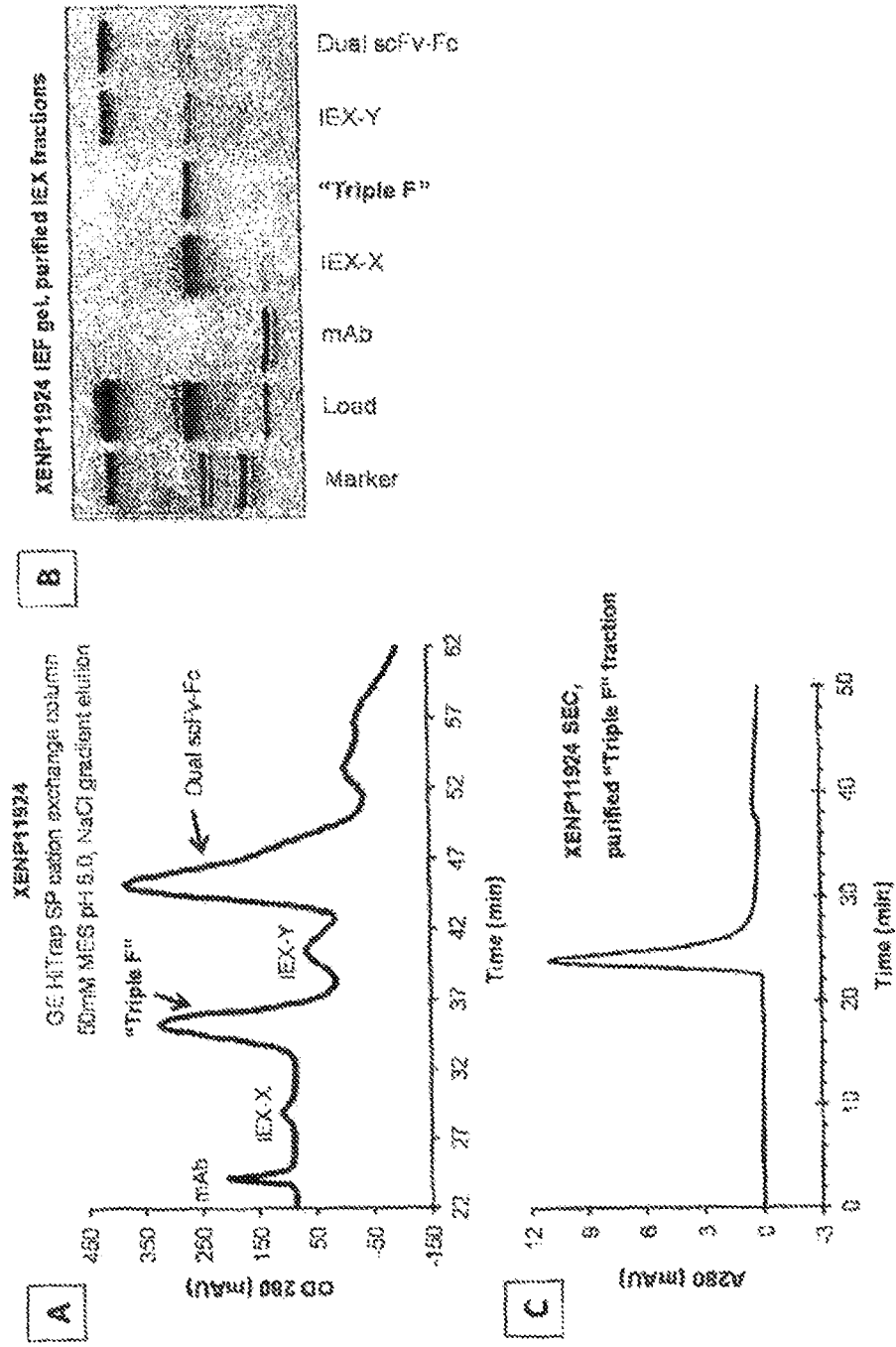
FIGS. 11A, 11B and 11C. The production of XENP11924, a "triple F" bispecific with an anti-CD 19 Fab and anti-CD3 scFv.

Furthermore, as will be appreciated by those in the art and outlined herein, heterodimers can be separated from homodimers on the basis of size. For example, as shown in FIG. 11, heterodimers with two scFvs (FIG. 1A) can be separated by those of the "triple F" format (FIG. 1B) and a bispecific mAb (FIG. 1C). This can be further exploited in higher valency with additional antigen binding sites being utilized. For example, as additionally shown, one monomer will have two Fab fragments and the other will have one scFv, resulting in a differential in size and thus molecular weight.

In addition, as will be appreciated by those in the art and outlined herein, the format outlined herein can be expanded to provide trispecific and tetraspecific antibodies as well. In this embodiment, some variations of which are depicted in the Figures, it will be recognized that it is possible that some antigens are bound divalently (e.g. two antigen binding sites to a single antigen; for example, A and B could be part of a typical bivalent association and C and D can be optionally present and optionally the same or different). As will be appreciated, any combination of Fab and scFvs can be utilized to achieve the desired result and combinations.

In the case where pI variants are used to achieve heterodimerization, by using the constant region(s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

In one embodiment, the heterodimeric antibody provides for monovalent engagement of one antigen using a scFv and monovalent engagement of the other antigen using a FAb. As outlined below, this format can also be varied; in some embodiments, there is monovalent engagement of three antigens, divalent engagement of one antigen and monovalent engagement of a second antigen (e.g. A and C are to the same antigen and B is to a different antigen), etc.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition to all or part of a variant heavy constant domain, one or both of the monomers may contain one or two fusion partners, such that the heterodimers form multivalent proteins. As is generally depicted in the FIG. 64 of U.S. Ser. No. 13/648,951, hereby incorporated by reference with its accompanying legend, the fusion partners are depicted as A, B, C and D, with all combinations possible. In general, A, B, C and D are selected such that the heterodimer is at least bispecific or bivalent in its ability to interact with additional proteins. In the context of the present "triple F" format, generally A and B are an scFv and a Fv (as will be appreciated, either monomer can contain the scFv and the other the Fv/Fab) and then optionally one or two additional fusion partners.

Furthermore, as outlined herein, additional amino acid variants may be introduced into the bispecific antibodies of the invention, to add additional functionalities. For example, amino acid changes within the Fc region can be added (either to one monomer or both) to facilitiate increased ADCC or CDC (e.g. altered binding to Fcγ receptors); to allow or increase yield of the addition of toxins and drugs (e.g. for ADC), as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies that bind CD3 monovalently and a tumor antigen on the other (e.g. CD19, her2/neu, etc.), it is generally desirable to ablate FcγRIIIa binding to eliminate or significantly reduce ADCC activity.

In addition, the invention provides novel humanized anti-CD3 sequences, including sets of CDRs, full variable light and heavy chains, as well as the associated scFvs, which can optionally include charged scFv linkers. These optimized sequences can be used in other antibody formats.

Accordingly, the present invention provides novel constructs to produce multivalent antibodies.

II. DEFINITIONS

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Variants of particular use when ablation variants (also sometimes referred to herein as "FcγR ablation variants", "Fc ablation variants", "Fc knock outs" ("FcKO") or "knock out" ("KO") variants) are used are those depicted in FIG. 33.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233# or E233del designates a deletion of glutamic acid at position 233. Additionally, EDA233– or EDA233# designates a deletion of the sequence GluAspAla that begins at position 233. Similarly, some of the heterodimerization variants include "K447del", meaning the lysine at position 447 has been deleted.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides". The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homo-phenylalanine, citrulline, ornithine and noreleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635):964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification. "Isotypic" modifications refer to the importation of one isotype amino acid at a position into the backbone of a different isotype; for example, the importation of an IgG1 amino acid into an IgG2 backbone at the same position.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcqammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are discussed in Legend A of FIG. 24.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc fusion protein" or "immunoadhesin" herein is meant a protein comprising an Fc region, generally linked (optionally through a linker moiety, as described herein) to a different protein, such as a binding moiety to a target protein, as described herein).

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities.

By "target antigen" as used herein is meant the molecule that is bound specifically by the variable region of a given antibody. A target antigen may be a protein, carbohydrate, lipid, or other chemical compound. A wide number of suitable target antigens are described below.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

By "single chain variable fragment", "scFv" or "single chain Fv" as is well understood in the art, herein is meant a fusion protein of the variable heavy and light chains of an antibody, usually linked with a linker peptide. Typical scFv linkers are well known in the art, are generally 10 to 25 amino acids in length and include glycines and serines.

By "charged scFv linker" herein is meant a scFv linker that utilizes charged amino acids for use in the creation and purification of heterodimeric antibodies that include at least one scFv. Suitable charged scFv linkers are shown in FIG. 7, although others can be used. In general, the charged scFv linkers for use in the present invention have a charge change from 3 to 8 (3, 4, 5, 6, 7 or 8 all being possible) as compared to the standard uncharged scFv linkers such as $(GGGGS)_{3-5}$ sequences traditionally used (either negative or positive). As will be appreciated by those in the art, heterodimeric antibodies that utilize two scFvs can have one charged and one neutral linker (e.g. either a positively or negatively charged scFv linker) or two oppositely charged scFv linkers (one positive and one negative).

Heterodimeric Proteins

The present invention is directed to the generation of multispecific, particularly bispecific binding proteins, and in particular, multispecific antibodies that have one monomer comprising an scFv and the other an Fv.

Antibodies

The present invention relates to the generation of multispecific antibodies, generally therapeutic antibodies. As is discussed below, the term "antibody" is used generally. Antibodies that find use in the present invention can take on a number of formats as described herein, including traditional antibodies as well as antibody derivatives, fragments and mimetics, described below. In general, the term "antibody" includes any polypeptide that includes at least one constant domain, including, but not limited to, CHL CH2, CH3 and CL.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) (e.g, Kabat et al., supra (1991)).

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that the sequences depicted herein start at the CH1 region, position 118; the variable regions are not included except as noted. For example, the first amino acid of SEQ ID NO: 2, while designated as position"1" in the sequence listing, corresponds to position 118 of the CH1 region, according to EU numbering.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region. By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

In some embodiments, the antibodies are full length. By "full length antibody" herein is meant the structure that constitutes the natural biological form of an antibody, including variable and constant regions, including one or more modifications as outlined herein.

Alternatively, the antibodies can include a variety of structures, including, but not limited to, antibody fragments, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and fragments of each, respectively.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. For example, Fc fusions are fusions of the Fc region (CH2 and CH3, optionally with the hinge region) fused to another protein. A number of Fc fusions are known the art and can be improved by the addition of the heterodimerization variants of the invention. In the present case, antibody fusions can be made comprising CH1; CH1, CH2 and CH3; CH2; CH3; CH2 and CH3; CH1 and CH3, any or all of which can be made optionally with the hinge region, utilizing any combination of heterodimerization variants described herein.

In some embodiments of the present invention, one monomer comprises a heavy chain comprises a scFV linked to an Fc domain, and the other monomer comprises a heavy chain comprising a Fab linked to an Fc domain, e.g. a "typical" heavy chain, and a light chain. By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody.

Chimeric and Humanized Antibodies

In some embodiments, the antibody can be a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321:522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

Multispecific Antibody Constructs

As will be appreciated by those in the art and discussed more fully below, the heterodimeric fusion proteins of the present invention take on a number variety of configurations, with a preferred embodiment shown in FIG. 1B as a "triple F" construct.

Heterodimeric Heavy Chain Constant Regions

Accordingly, the present invention provides heterodimeric proteins based on the use of monomers containing variant heavy chain constant regions as a first domain. By "monomer" herein is meant one half of the heterodimeric protein. It should be noted that traditional antibodies are actually tetrameric (two heavy chains and two light chains). In the context of the present invention, one pair of heavy-light chains (if applicable, e.g. if the monomer comprises an Fab) is considered a "monomer". Similarly, a heavy chain region comprising the scFv is considered a monomer. In the case where an Fv region is one fusion partner (e.g. heavy and light chain) and a non-antibody protein is another fusion partner, each "half" is considered a monomer. Essentially, each monomer comprises sufficient heavy chain constant region to allow heterodimerization engineering, whether that be all the constant region, e.g. Ch1-hinge-CH2-CH3, the Fc region (CH2-CH3), or just the CH3 domain.

The variant heavy chain constant regions can comprise all or part of the heavy chain constant region, including the full length construct, CH1-hinge-CH2-CH3, or portions thereof, including for example CH2-CH3 or CH3 alone. In addition, the heavy chain region of each monomer can be the same backbone (CH1-hinge-CH2-CH3 or CH2-CH3) or different. N- and C-terminal truncations and additions are also included within the definition; for example, some pI variants include the addition of charged amino acids to the C-terminus of the heavy chain domain.

Thus, in general, one monomer of the present "triple F" construct is a scFv region-hinge-Fc domain) and the other is (VH-CH1-hinge-CH2-CH3 plus associated light chain), with heterodimerization variants, including steric and pI variants, Fc and FcRn variants, and additional antigen binding domains (with optional linkers) included in these regions.

In addition to the heterodimerization variants (e.g. steric and pI variants) outlined herein, the heavy chain regions may also contain additional amino acid substitutions, including changes for altering FcγR and FcRn binding as discussed below.

In addition, some monomers can utilize linkers between the variant heavy chain constant region and the fusion partner. For the scFv portion of the "bottle-opener", standard linkers as are known in the art can be used. In the case where additional fusion partners are made (e.g. FIG. 64 of U.S. Ser. No. 13/648,951), traditional peptide linkers can be used, including flexible linkers of glycine and serine. In some cases, the linkers for use as components of the monomer are different from those defined below for the ADC constructs, and are in many embodiments not cleavable linkers (such as those susceptible to proteases), although cleavable linkers may find use in some embodiments.

Alternatively, depending on the antibody format, one or more charged scFv linkers can be utilized as outlined herein. In Triple F format, one charged scFv linker is used. As noted herein, depending on the inherent pI of the scFv for the target antigen and the inherent pI of the Fab of the other target antigen, the charged scFv linker can either be positive or negative. In dual scFv formats, either a single charged scFv linker is used on one monomer (again, either positive or negative) or both (one positive and one negative). In this embodiment, the charge of each of the two linkers need not be the same (e.g. +3 for one and −4 for the other, etc.).

The heterodimerization variants include a number of different types of variants, including, but not limited to, steric variants (including charge variants) and pI variants, that can be optionally and independently combined with any other variants. In these embodiments, it is important to match "monomer A" with "monomer B"; that is, if a heterodimeric protein relies on both steric variants and pI variants, these need to be correctly matched to each monomer: e.g. the set of steric variants that work (1 set on monomer A, 1 set on monomer B) is combined with pI variant sets (1 set on monomer A, 1 set on monomer B), such that the variants on each monomer are designed to achieve the desired function. In the case for example where steric variants may also change the charge, the correct sets have to be matched to the correct monomer.

It is important to note that the heterodimerization variants outlined herein (for example, including but not limited to those variants shown in FIGS. 9, 26, 29, 30, 31 and 32), can be optionally and independently combined with any other variants, and on any other monomer. Thus, for example, pI variants for monomer 1 from one figure can be added to other heterodimerization variants for monomer 1 in a different figure or from monomer 2. That is, what is important for the heterodimerization is that there are "sets" of variants, one set for one monomer and one set for the other. Whether these are combined from the Figures 1 to 1 (e.g. monomer 1 listings can go together) or switched (monomer 1 pI variants with monomer 2 steric variants) is irrelevant. However, as noted herein, "strandedness" should be preserved when combinations are made as outlined above such that heterodimerization is favored; e.g. charge variants that increase pI should be used with increased pI variants and/or an scFv linker with increase pI, etc. Furthermore, for the additional Fc variants (such as for FcγR binding, FcRn binding, ablation variants etc.), either monomer, or both monomers, can include any of the listed variants, independently and optionally. In some cases, both monomers have the additional variants and in some only one monomer has the additional variants, or they can be combined.

Heterodimerization Variants

The present invention provides multispecific antibody formats, on a "triple F" or "bottle opener" scaffold as depicted in FIG. 11B, for example.

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are shown in the Figures One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. FIGS. 4 and 5, further described below, identifies a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, variants resulting in greater than 75% heterodimerization in the Figures such as D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend of which are incorporated expressly by reference herein.

In some embodiments, the steric variants outlined herein can be optionally and independently incorporated with any heterodimerization variants including pI variants (or other variants such as Fc variants, FcRn variants, ablation variants, etc.) into one or both monomers.

pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in the Figures.

Heavy Chain Acidic pI Changes

Accordingly, when one monomer comprising a variant heavy chain constant domain is to be made more positive (e.g. lower the pI), one or more of the following substitutions can be made: S119E, K133E, K133Q, T164E, K205E, K205Q, N208D, K210E, K210Q, K274E, K320E, K322E, K326E, K334E, R355E, K392E, a deletion of K447, adding peptide DEDE at the c-terminus, G137E, N203D, K274Q, R355Q, K392N and Q419E. As outlined herein and shown in the figures, these changes are shown relative to IgG1, but all isotypes can be altered this way, as well as isotype hybrids.

In the case where the heavy chain constant domain is from IgG2-4, R133E and R133Q can also be used.

Basic pI Changes

Accordingly, when one monomer comprising a variant heavy chain constant domain is to be made more negative (e.g. increase the pI), one or more of the following substitutions can be made: Q196K, P217R, P228R, N276K and H435R. As outlined herein and shown in the figures, these changes are shown relative to IgG1, but all isotypes can be altered this way, as well as isotype hybrids.

Antibody Heterodimers Light Chain Variants

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE at the c-terminus of the light chain. Changes in this category based on the constant lambda light chain include one or more substitutions at R108Q, Q124E, K126Q, N138D, K145T and Q199E. In addition, increasing the pI of the light chains can also be done.

Isotypic Variants

In addition, many embodiments of the invention rely on the "importation" of pI amino acids at particular positions from one IgG isotype into another, thus reducing or eliminating the possibility of unwanted immunogenicity being introduced into the variants. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the Figures. Alternatively, the pI of each monomer can be compared. Similarly, the pIs of the "starting" variable regions (e.g. either scFv or Fab) are calculated to inform which monomer will be engineered in which direction.

pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dail' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

pI variants that find use in this embodiment, as well as their use for purification optimization, are disclosed in the Figures.

Combination of Heterodimeric Variants

As will be appreciated by those in the art, all of the recited heterodimerization variants can be optionally and independently combined in any way, as long as they retain their "strandedness" or "monomer partition". In addition, all of these variants can be combined into any of the hterodimerization formats. See FIG. 28 and its legend.

In the case of pI variants, while embodiments finding particular use are shown in the Figures, other combinations can be generated, following the basic rule of altering the pI difference between two monomers to facilitate purification.

Target Antigens

The immunoglobulins of the invention may target virtually any antigens. The "triple F" format is particularly beneficial for targeting two (or more) distinct antigens. (As outlined herein, this targeting can be any combination of monovalent and divalent binding, depending on the format). Thus the immunoglobulins herein preferably co-engage two target antigens, although in some cases, three or four antigens can be monovalently engaged. Each monomer's specificity can be selected from the lists below. While the triple F immunoglobulins described herein are particularly beneficial for targeting distinct antigens, in some cases it may be beneficial to target only one antigen. That is, each monomer may have specificity for the same antigen.

Particular suitable applications of the immunoglobulins herein are co-target pairs for which it is beneficial or critical to engage each target antigen monovalently. Such antigens may be, for example, immune receptors that are activated upon immune complexation. Cellular activation of many immune receptors occurs only by cross-linking, achieved typically by antibody/antigen immune complexes, or via effector cell to target cell engagement. For some immune receptors, for example the CD3 signaling receptor on T cells, activation only upon engagement with co-engaged target is critical, as nonspecific cross-linking in a clinical setting can elicit a cytokine storm and toxicity. Therapeutically, by engaging such antigens monovalently rather than multivalently, using the immunoglobulins herein, such activation occurs only in response to cross-linking only in the microenvironment of the primary target antigen. The ability to target two different antigens with different valencies is a novel and useful aspect of the present invention. Examples of target antigens for which it may be therapeutically beneficial or necessary to co-engage monovalently include but are not limited to immune activating receptors such as CD3, FcγRs, toll-like receptors (TLRs) such as TLR4 and TLR9, cytokine, chemokine, cytokine receptors, and chemokine receptors. In many embodiments, one of the antigen binding sites binds to CD3, and in some embodiments it is the scFv-containing monomer.

Virtually any antigen may be targeted by the immunoglobulins herein, including but not limited to proteins, subunits, domains, motifs, and/or epitopes belonging to the following list of target antigens, which includes both soluble factors such as cytokines and membrane-bound factors, including transmembrane receptors: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RITA, Activin RIIB, ADAM, ADAM10, ADAM12, ADAM15, ADAM17/TACE, ADAMS, ADAMS, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Ax1, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, C10, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, Enkephalinase, eNOS, Eot, eotaxin1, EpCAM, Ephrin B2/EphB4, EPO, ERCC, E-selectin, ET-1, Factor IIa, Factor VII, Factor VIIIc, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin alpha4/beta7, integrin alpha5 (alphaV), integrin alpha5/beta1, integrin alpha5/beta3, integrin alpha6, integrin beta1, integrin beta2, interferon gamma, IP-10, I-TAC, JE, Kallikrein 2, Kallikrein 5, Kallikrein 6, Kallikrein 11, Kallikrein 12, Kallikrein 14, Kallikrein 15, Kallikrein L1, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bp1, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Muc1), MUC18, Muellerian-inhibitin substance, Mug, MuSK, NAIP, NAP, NCAD, N-Cadherin, NCA 90, NCAM, NCAM, Neprilysin, Neurotrophin-3,-4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGD2, PIN, PLA2, placental alkaline phosphatase (PLAP), PlGF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RH CD120b, p75-80), TNFRSF26 (TNFRH3), TNFRSF3 (LTbR TNF RIII, TNFC R), TNFRSF4 (OX40 ACT35, TXGP1R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSF1A (TNF-a Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF9 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, and receptors for hormones and growth factors. To form the bispecific or trispecific antibodies of the invention, antibodies to any combination of these antigens can be made; that is, each of these antigens can be optionally and independently included or excluded from a multispecific antibody according to the present invention.

Exemplary antigens that may be targeted specifically by the immunoglobulins of the invention include but are not limited to: CD20, CD19, Her2, EGFR, EpCAM, CD3, FcγRIIIa (CD16), FcγRIIa (CD32a), FcγRIIb (CD32b), FcγRI (CD64), Toll-like receptors (TLRs) such as TLR4 and TLR9, cytokines such as IL-2, IL-5, IL-13, IL-12, IL-23, and TNFα, cytokine receptors such as IL-2R, chemokines, chemokine receptors, growth factors such as VEGF and HGF, and the like. To form the multispecific antibodies of the invention, antibodies to any combination of these antigens can be made; that is, each of these antigens can be optionally and independently included or excluded from a multispecific antibody according to the present invention.

Particularly preferred combinations for bispecific antibodies are an antigen-binding domain to CD3 and an antigen binding domain to CD19; an antigen-binding domain to CD3 and an antigen binding domain to CD33; an antigen-binding domain to CD3 and an antigen binding domain to CD 38. Again, in many embodiments, the CD3 binding domain is the scFv, having an exemplary sequence as depicted in the Figures and/or CD3 CDRs as outlined.

The choice of suitable target antigens and co-targets depends on the desired therapeutic application. Some targets that have proven especially amenable to antibody therapy are those with signaling functions. Other therapeutic antibodies exert their effects by blocking signaling of the receptor by inhibiting the binding between a receptor and its cognate ligand. Another mechanism of action of therapeutic antibodies is to cause receptor down regulation. Other antibodies do not work by signaling through their target antigen. The choice of co-targets will depend on the detailed biology underlying the pathology of the indication that is being treated.

Monoclonal antibody therapy has emerged as an important therapeutic modality for cancer (Weiner et al., 2010, Nature Reviews Immunology 10:317-327; Reichert et al., 2005, Nature Biotechnology 23[9]:1073-1078; herein expressly incorporated by reference). For anti-cancer treatment it may be desirable to target one antigen (antigen-1) whose expression is restricted to the cancerous cells while co-targeting a second antigen (antigen-2) that mediates some immunological killing activity. For other treatments it may be beneficial to co-target two antigens, for example two angiogenic factors or two growth factors, that are each known to play some role in proliferation of the tumor. Exemplary co-targets for oncology include but are not limited to HGF and VEGF, IGF-1R and VEGF, Her2 and VEGF, CD19 and CD3, CD20 and CD3, Her2 and CD3, CD19 and FcγRIIIa, CD20 and FcγRIIIa, Her2 and FcγRIIIa. An immunoglobulin of the invention may be capable of binding VEGF and phosphatidylserine; VEGF and ErbB3; VEGF and PLGF; VEGF and ROBO4; VEGF and BSG2; VEGF and CDCP1; VEGF and ANPEP; VEGF and c-MET; HER-2 and ERB3; HER-2 and BSG2; HER-2 and CDCP1; HER-2 and ANPEP; EGFR and CD64; EGFR and BSG2; EGFR and CDCP1; EGFR and ANPEP; IGF1R and PDGFR; IGF1R and VEGF; IGF1R and CD20; CD20 and CD74; CD20 and CD30; CD20 and DR4; CD20 and VEGFR2; CD20 and CD52; CD20 and CD4; HGF and c-MET; HGF and NRP1; HGF and phosphatidylserine; ErbB3 and IGF1R; ErbB3 and IGF1,2; c-Met and Her-2; c-Met and NRP1; c-Met and IGF1R; IGF1,2 and PDGFR; IGF1,2 and CD20; IGF1,2 and IGF1R; IGF2 and EGFR; IGF2 and HER2; IGF2 and CD20; IGF2 and VEGF; IGF2 and IGF1R; IGF1 and IGF2; PDGFRa and VEGFR2; PDGFRa and PLGF; PDGFRa and VEGF; PDGFRa and c-Met; PDGFRa and EGFR; PDGFRb and VEGFR2; PDGFRb and c-Met; PDGFRb and EGFR; RON and c-Met; RON and MTSP1; RON and MSP; RON and CDCP1; VGFR1 and PLGF; VGFR1 and RON; VGFR1 and EGFR; VEGFR2 and PLGF; VEGFR2 and NRP1; VEGFR2 and RON; VEGFR2 and DLL4; VEGFR2 and EGFR; VEGFR2 and ROBO4; VEGFR2 and CD55; LPA and S1P; EPHB2 and RON; CTLA4 and VEGF; CD3 and EPCAM; CD40 and IL6; CD40 and IGF; CD40 and CD56; CD40 and CD70; CD40 and VEGFR1; CD40 and DR5; CD40 and DR4; CD40 and APRIL; CD40 and BCMA; CD40 and RANKL; CD28 and MAPG; CD80 and CD40; CD80 and CD30; CD80 and CD33; CD80 and CD74; CD80 and CD2; CD80 and CD3; CD80 and CD19; CD80 and CD4; CD80 and CD52; CD80 and VEGF; CD80 and DR5; CD80 and VEGFR2; CD22 and CD20; CD22 and CD80; CD22 and CD40; CD22 and CD23; CD22 and CD33; CD22 and CD74; CD22 and CD19; CD22 and DR5; CD22 and DR4; CD22 and VEGF; CD22 and CD52; CD30 and CD20; CD30 and CD22; CD30 and CD23; CD30 and CD40; CD30 and VEGF; CD30 and CD74; CD30 and CD19; CD30 and DR5; CD30 and DR4; CD30 and VEGFR2; CD30 and CD52; CD30 and CD4; CD138 and RANKL; CD33 and FTL3; CD33 and VEGF; CD33 and VEGFR2; CD33 and CD44; CD33 and DR4; CD33 and DR5; DR4 and CD137; DR4 and IGF1,2; DR4 and IGF1R; DR4 and DR5; DR5 and CD40; DR5 and CD137; DR5 and CD20; DR5 and EGFR; DR5 and IGF1,2; DR5 and IGFR, DR5 and HER-2, and EGFR and DLL4. Other target combinations include one or more members of the EGF/erb-2/erb-3 family.

Other targets (one or more) involved in oncological diseases that the immunoglobulins herein may bind include, but are not limited to those selected from the group consisting of: CD52, CD20, CD19, CD3, CD4, CD8, BMP6, IL12A, IL1A, IL1B, 1L2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, 1L2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR1I3, NR2F6, NR4A3, ESR1, ESR2, NROB1, NROB2, NR1D2, NR1H2, NR1H4, NR1I2, NR2C1, NR2C2, NR2E1, NR2E3, NR2F1, NR2F2, NR3C1, NR3C2, NR4A1, NR4A2, NR5A1, NR5A2, NR6 μl, PGR, RARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, 1L2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH2O, CDH7, CDH9, CDH1, CDH10, CDH13, CDH18, CDH19, CDH2O, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB21P, DES, DNCL1, ELAC2, ENO2, ENO3, FASN, FLJ12584, FLJ25530, GAGEB1, GAGEC1, GGT1, GSTP1, HIP1, HUMCYT2A, IL29, K6HF, KAI1, KRT2A, MIB1, PART1, PATE, PCA3, PIAS2, PIK3CG, PPID, HU, PSCA, SLC2A2, SLC33 μl, SLC43 μl, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMAS, NRP1, NRP2, PGF, PLXDC1, STAB 1, VEGF, VEGFC, ANGPTL3, BAIL COL4A3, IL8, LAMAS, NRP1, NRP2, STAB 1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL1A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p16INK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (GF), NGFR, NME1 (M23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase IIa), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Spr1), THBS1, THBS2, THBS4, and TNFAIP2 (B94), RON, c-Met, CD64, DLL4, PLGF, CTLA4, phophatidylserine, ROBO4, CD80, CD22, CD40, CD23, CD28, CD80, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59. To form the bispecific or trispecific antibodies of the invention, antibodies to any combination of these antigens can be made; that is, each of these antigens can be optionally and independently included or excluded from a multispecific antibody according to the present invention.

Monoclonal antibody therapy has become an important therapeutic modality for treating autoimmune and inflammatory disorders (Chan & Carter, 2010, Nature Reviews Immunology 10:301-316; Reichert et al., 2005, Nature Biotechnology 23[9]:1073-1078; herein expressly incorporated by reference). Many proteins have been implicated in general autoimmune and inflammatory responses, and thus may be targeted by the immungloublins of the invention. Autoimmune and inflammatory targets include but are not limited to C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL5, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL8RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL12RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFB1, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144). To form the bispecific or trispecific antibodies of the invention, antibodies to any combination of these antigens can be made; that is, each of these antigens can be optionally and independently included or excluded from a multispecific antibody according to the present invention.

Exemplary co-targets for autoimmune and inflammatory disorders include but are not limited to IL-1 and TNFalpha, IL-6 and TNFalpha, IL-6 and IL-1, IgE and IL-13, IL-1 and IL-13, IL-4 and IL-13, IL-5 and IL-13, IL-9 and IL-13, CD19 and FcγRIIb, and CD79 and FcγRIIb.

Immunglobulins of the invention with specificity for the following pairs of targets to treat inflammatory disease are contemplated: TNF and IL-17A; TNF and RANKL; TNF and VEGF; TNF and SOST; TNF and DKK; TNF and alphaVbeta3; TNF and NGF; TNF and IL-23p19; TNF and IL-6; TNF and SOST; TNF and IL-6R; TNF and CD-20; IgE and IL-13; IL-13 and IL23p19; IgE and IL-4; IgE and IL-9; IgE and IL-9; IgE and IL-13; IL-13 and IL-9; IL-13 and IL-4; IL-13 and IL-9; IL-13 and IL-9; IL-13 and IL-4; IL-13 and IL-23p19; IL-13 and IL-9; IL-6R and VEGF; IL-6R and IL-17A; IL-6R and RANKL; IL-17A and IL-1beta; IL-1beta and RANKL; IL-1beta and VEGF; RANKL and CD-20; IL-1alpha and IL-1beta; IL-1alpha and IL-1beta.

Pairs of targets that the immunoglobulins described herein can bind and be useful to treat asthma may be determined. In an embodiment, such targets include, but are not limited to, IL-13 and IL-1beta, since IL-1beta is also implicated in inflammatory response in asthma; IL-13 and cytokines and chemokines that are involved in inflammation, such as IL-13 and IL-9; IL-13 and IL-4; IL-13 and IL-5; IL-13 and IL-25; IL-13 and TARC; IL-13 and MDC; IL-13 and MIF; IL-13 and TGF-β; IL-13 and LHR agonist; IL-13 and CL25; IL-13 and SPRR2a; IL-13 and SPRR2b; and IL-13 and ADAMS. The immunoglobulins herein may have specificity for one or more targets involved in asthma selected from the group consisting of CSF1 (MCSF), CSF2 (GM-CSF), CSF3 (GCSF), FGF2, IFNA1, IFNB1, IFNG, histamine and histamine receptors, IL1A, IL1B, IL2, IL3, IL4, IL5, IL6, IL7, IL8, IL9, IL10, IL11, IL12A, IL12B, IL13, IL14, IL15, IL16, IL17, IL18, IL19, KITLG, PDGFB, IL2RA, IL4R, IL5RA, IL8RA, IL8RB, IL12RB1, IL12RB2, IL13RA1, IL13RA2, IL18R1, TSLP, CCLi, CCL2, CCL3, CCL4, CCL5, CCL7, CCL8, CCL13, CCL17, CCL18, CCL19, CCL20, CCL22, CCL24, CX3CL1, CXCL1, CXCL2, CXCL3, XCLi, CCR2, CCR3, CCR4, CCR5, CCR6, CCR7, CCR8, CX3CR1, GPR2, XCR1, FOS, GATA3, JAK1, JAK3, STATE, TBX21, TGFB1, TNF, TNFSF6, YY1, CYSLTR1, FCER1A, FCER2, LTB4R, TB4R2, LTBR, and Chitinase. To form the bispecific or trispecific antibodies of the invention, antibodies to any combination of these antigens can be made; that is, each of these antigens can be optionally and independently included or excluded from a multispecific antibody according to the present invention.

Pairs of targets involved in rheumatoid arthritis (RA) may be co-targeted by the invention, including but not limited to TNF and IL-18; TNF and IL-12; TNF and IL-23; TNF and IL-1beta; TNF and MIF; TNF and IL-17; and TNF and IL-15.

Antigens that may be targeted in order to treat systemic lupus erythematosus (SLE) by the immunoglobulins herein include but are not limited to CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGSI, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, ILIR2, ITGA2, ITGA3, MS4A1, ST6GALI, CDIC, CHSTIO, HLA-A, HLA-DRA, and NT5E; CTLA4, B7.1, B7.2, BlyS, BAFF, C5, IL-4, IL-6, IL-10, IFN-α, and TNF-α. To form the bispecific or trispecific antibodies of the invention, antibodies to any combination of these antigens can be made; that is, each of these antigens can be optionally and independently included or excluded from a multispecific antibody according to the present invention.

The immunoglobulins herein may target antigens for the treatment of multiple sclerosis (MS), including but not limited to IL-12, TWEAK, IL-23, CXCL13, CD40, CD40L, IL-18, VEGF, VLA-4, TNF, CD45RB, CD200, IFNgamma, GM-CSF, FGF, C5, CD52, and CCR2. An embodiment includes co-engagement of anti-IL-12 and TWEAK for the treatment of MS.

One aspect of the invention pertains to immunoglobulins capable of binding one or more targets involved in sepsis, in an embodiment two targets, selected from the group consisting TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFKB1, PROC, TNFRSFIA, CSF3, CCR3, ILIRN, MIF, NFKB1, PTAFR, TLR2, TLR4, GPR44, HMOX1, midkine, IRAK1, NFKB2, SERPINAL SERPINEL and TREM1. To form the bispecific or trispecific antibodies of the invention, antibodies to any combination of these antigens can be made; that is, each of these antigens can be optionally and independently included or excluded from a multispecific antibody according to the present invention.

In some cases, immunoglobulins herein may be directed against antigens for the treatment of infectious diseases.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

Modified Antibodies

In addition to the modifications outlined above, other modifications can be made. For example, the molecules may be stabilized by the incorporation of disulphide bridges linking the VH and VL domains (Reiter et al., 1996, Nature Biotech. 14:1239-1245, entirely incorporated by reference). In addition, there are a variety of covalent modifications of antibodies that can be made as outlined below.

Covalent modifications of antibodies are included within the scope of this invention, and are generally, but not always, done post-translationally. For example, several types of covalent modifications of the antibody are introduced into the molecule by reacting specific amino acid residues of the antibody with an organic derivatizing agent that is capable of reacting with selected side chains or the N- or C-terminal residues.

Cysteinyl residues most commonly are reacted with a-haloacetates (and corresponding amines), such as chloroacetic acid or chloroacetamide, to give carboxymethyl or carboxyamidomethyl derivatives. Cysteinyl residues may also be derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole and the like.

In addition, modifications at cysteines are particularly useful in antibody-drug conjugate (ADC) applications, further described below. In some embodiments, the constant region of the antibodies can be engineered to contain one or more cysteines that are particularly "thiol reactive", so as to allow more specific and controlled placement of the drug moiety. See for example U.S. Pat. No. 7,521,541, incorporated by reference in its entirety herein.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1M sodium cacodylate at pH 6.0.

Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for cross-linking antibodies to a water-insoluble support matrix or surface for use in a variety of methods, in addition to methods described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cynomolgusogen bromide-activated carbohydrates and the reactive substrates described in U.S. Pat. Nos. 3,969,287; 3,691,016; 4,195,128; 4,247,642; 4,229,537; and 4,330,440, all entirely incorporated by reference, are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the a-amino groups of lysine, arginine, and histidine side chains (T. E. Creighton, Proteins: Structure and Molecular Properties, W. H. Freeman & Co., San Francisco, pp. 79-86 [1983], entirely incorporated by reference), acetylation of the N-terminal amine, and amidation of any C-terminal carboxyl group.

In addition, as will be appreciated by those in the art, labels (including fluorescent, enzymatic, magnetic, radioactive, etc. can all be added to the antibodies (as well as the other compositions of the invention).

Glycosylation

Another type of covalent modification is alterations in glycosylation. In another embodiment, the antibodies disclosed herein can be modified to include one or more engineered glycoforms. By "engineered glycoform" as used herein is meant a carbohydrate composition that is covalently attached to the antibody, wherein said carbohydrate composition differs chemically from that of a parent antibody. Engineered glycoforms may be useful for a variety of purposes, including but not limited to enhancing or reducing effector function. A preferred form of engineered glycoform is afucosylation, which has been shown to be correlated to an increase in ADCC function, presumably through tighter binding to the FcγRIIIa receptor. In this context, "afucosylation" means that the majority of the antibody produced in the host cells is substantially devoid of fucose, e.g. 90-95-98% of the generated antibodies do not have appreciable fucose as a component of the carbohydrate moiety of the antibody (generally attached at N297 in the Fc region). Defined functionally, afucosylated antibodies generally exhibit at least a 50% or higher affinity to the FcγRIIIa receptor.

Engineered glycoforms may be generated by a variety of methods known in the art (Umaña et al., 1999, Nat Biotechnol 17:176-180; Davies et al., 2001, Biotechnol Bioeng 74:288-294; Shields et al., 2002, J Biol Chem 277:26733-26740; Shinkawa et al., 2003, J Biol Chem 278:3466-3473; U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1, all entirely incorporated by reference; (Potelligent® technology [Biowa, Inc., Princeton, N.J.]; GlycoMAb® glycosylation engineering technology [Glycart Biotechnology AG, Zurich, Switzerland]). Many of these techniques are based on controlling the level of fucosylated and/or bisecting oligosaccharides that are covalently attached to the Fc region, for example by expressing an IgG in various organisms or cell lines, engineered or otherwise (for example Lec-13 CHO cells or rat hybridoma YB2/0 cells, by regulating enzymes involved in the glycosylation pathway (for example FUT8 [α1,6-fucosyltranserase] and/or [31-4-N-acetylglucosaminyltransferase III [GnTIII]), or by modifying carbohydrate(s) after the IgG has been expressed. For example, the "sugar engineered antibody" or "SEA technology" of Seattle Genetics functions by adding modified saccharides that inhibit fucosylation during production; see for example 20090317869, hereby incorporated by reference in its entirety. Engineered glycoform typically refers to the different carbohydrate or oligosaccharide; thus an antibody can include an engineered glycoform.

Alternatively, engineered glycoform may refer to the IgG variant that comprises the different carbohydrate or oligosaccharide. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antibody amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antibody is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, 1981, CRC Crit. Rev. Biochem., pp. 259-306, both entirely incorporated by reference.

Removal of carbohydrate moieties present on the starting antibody (e.g. post-translationally) may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131, both entirely incorporated by reference. Enzymatic cleavage of carbohydrate moieties on polypeptides can be achieved by the use of a variety of endo- and exo-glycosidases as described by Thotakura et al., 1987, Meth. Enzymol. 138:350, entirely incorporated by reference. Glycosylation at potential glycosylation sites may be prevented by the use of the compound tunicamycin as described by Duskin et al., 1982, J. Biol. Chem. 257:3105, entirely incorporated by reference. Tunicamycin blocks the formation of protein-N-glycoside linkages.

Another type of covalent modification of the antibody comprises linking the antibody to various nonproteinaceous polymers, including, but not limited to, various polyols such as polyethylene glycol, polypropylene glycol or polyoxyalkylenes, in the manner set forth in, for example, 2005-2006 PEG Catalog from Nektar Therapeutics (available at the Nektar website) U.S. Pat. Nos. 4,640,835; 4,496,689; 4,301,144; 4,670,417; 4,791,192 or 4,179,337, all entirely incorporated by reference. In addition, as is known in the art, amino acid substitutions may be made in various positions within the antibody to facilitate the addition of polymers such as PEG. See for example, U.S. Publication No. 2005/0114037A1, entirely incorporated by reference.

Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants FcγR Variants Accordingly, there are a number of useful Fc substitutions that can be made to alter binding to one or more of the FcγR receptors. Substitutions that result in increased binding as well as decreased binding can be useful. For example, it is known that increased binding to Fc RIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances Amino acid substitutions that find use in the present invention include those listed in U.S. Ser. Nos. 11/124,620 (particularly FIG. 41), 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 428L, 308F, 259I, 428L/434S, 259I/308F, 436I/428L, 436I or V/434S, 436V/428L and 259I/308F/428L.

Fc Ablation Variants

Additional variants which find use in the present invention are those that ablate (e.g. reduce or eliminate) binding to Fcγreceptors. This can be desirable to reduce the potential mechanisms of action (e.g. reduce ADCC activity) of the heterodimeric antibodies of the invention. A number of suitable Fc ablation variants are depicted in FIG. 33, and can be optionally and independently included or excluded in combination with any other heterodimerization variants, including pI and steric variants.

Linkers

The present invention optionally provides linkers as needed, for example in the addition of additional antigen binding sites, as depicted for example in FIGS. 11, 12 and 13, where "the other end" of the molecule contains additional antigen binding components. In addition, as outlined below, linkers are optionally also used in antibody drug conjugate (ADC) systems. When used to join the components of the central mAb-Fv constructs, the linker is generally a polypeptide comprising two or more amino acid residues joined by peptide bonds and are used to link one or more of the components of the present invention. Such linker polypeptides are well known in the art (see e.g., Holliger, P., et al. (1993) Proc. Natl. Acad. Sci. USA 90:6444-6448; Poljak, R. J., et al. (1994) Structure 2:1121-1123). A variety of linkers may find use in some embodiments described herein. As will be appreciated by those in the art, there are at least three different linker types used in the present invention.

"Linker" herein is also referred to as "linker sequence", "spacer", "tethering sequence" or grammatical equivalents thereof. Homo- or hetero-bifunctional linkers as are well known (see, 1994 Pierce Chemical Company catalog, technical section on cross-linkers, pages 155-200, incorporated entirely by reference). (Note the distinction between generic "linkers" and "scFv linkers and "charged scFv linkers"). A number of strategies may be used to covalently link molecules together. These include, but are not limited to polypeptide linkages between N- and C-termini of proteins or protein domains, linkage via disulfide bonds, and linkage via chemical cross-linking reagents. In one aspect of this embodiment, the linker is a peptide bond, generated by recombinant techniques or peptide synthesis. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used. Useful linkers include glycine-serine polymers, including for example (GS)n, (GSGGS)n, (GGGGS)n, and (GGGS)n, where n is an integer of at least one, glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

Antibody-Drug Conjugates

In some embodiments, the multispecific antibodies of the invention are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc. An overview of this technology is provided in Ducry et al., Bioconjugate Chem., 21:5-13 (2010), Carter et al., Cancer J. 14(3):154 (2008) and Senter, Current Opin. Chem. Biol. 13:235-244 (2009), all of which are hereby incorporated by reference in their entirety.

Thus the invention provides multispecific antibodies conjugated to drugs. Generally, conjugation is done by covalent attachment to the antibody, as further described below, and generally relies on a linker, often a peptide linkage (which, as described below, may be designed to be sensitive to cleavage by proteases at the target site or not). In addition, as described above, linkage of the linker-drug unit (LU-D) can be done by attachment to cysteines within the antibody. As will be appreciated by those in the art, the number of drug moieties per antibody can change, depending on the conditions of the reaction, and can vary from 1:1 to 10:1 drug: antibody. As will be appreciated by those in the art, the actual number is an average.

Thus the invention provides multispecific antibodies conjugated to drugs. As described below, the drug of the ADC can be any number of agents, including but not limited to cytotoxic agents such as chemotherapeutic agents, growth inhibitory agents, toxins (for example, an enzymatically active toxin of bacterial, fungal, plant, or animal origin, or fragments thereof), or a radioactive isotope (that is, a radioconjugate) are provided. In other embodiments, the invention further provides methods of using the ADCs.

Drugs for use in the present invention include cytotoxic drugs, particularly those which are used for cancer therapy. Such drugs include, in general, DNA damaging agents, anti-metabolites, natural products and their analogs. Exemplary classes of cytotoxic agents include the enzyme inhibitors such as dihydrofolate reductase inhibitors, and thymidylate synthase inhibitors, DNA intercalators, DNA cleavers, topoisomerase inhibitors, the anthracycline family of drugs, the vinca drugs, the mitomycins, the bleomycins, the cytotoxic nucleosides, the pteridine family of drugs, diynenes, the podophyllotoxins, dolastatins, maytansinoids, differentiation inducers, and taxols.

Members of these classes include, for example, methotrexate, methopterin, dichloromethotrexate, 5-fluorouracil, 6-mercaptopurine, cytosine arabinoside, melphalan, leurosine, leurosideine, actinomycin, daunorubicin, doxorubicin, mitomycin C, mitomycin A, caminomycin, aminopterin, tallysomycin, podophyllotoxin and podophyllotoxin derivatives such as etoposide or etoposide phosphate, vinblastine, vincristine, vindesine, taxanes including taxol, taxotere retinoic acid, butyric acid, N8-acetyl spermidine, camptothecin, calicheamicin, esperamicin, ene-diynes, duocarmycin A, duocarmycin SA, calicheamicin, camptothecin, maytansinoids (including DM1), monomethylauristatin E (MMAE), monomethylauristatin F (MMAF), and maytansinoids (DM4) and their analogues.

Toxins may be used as antibody-toxin conjugates and include bacterial toxins such as diphtheria toxin, plant toxins such as ricin, small molecule toxins such as geldanamycin (Mandler et al (2000) J. Nat. Cancer Inst. 92(19):1573-1581; Mandler et al (2000) Bioorganic & Med. Chem. Letters 10:1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). Toxins may exert their cytotoxic and cytostatic effects by mechanisms including tubulin binding, DNA binding, or topoisomerase inhibition.

Conjugates of a multispecific antibody and one or more small molecule toxins, such as a maytansinoids, dolastatins, auristatins, a trichothecene, calicheamicin, and CC1065, and the derivatives of these toxins that have toxin activity, are contemplated.

Maytansinoids

Maytansine compounds suitable for use as maytansinoid drug moieties are well known in the art, and can be isolated from natural sources according to known methods, produced using genetic engineering techniques (see Yu et al (2002) PNAS 99:7968-7973), or maytansinol and maytansinol analogues prepared synthetically according to known methods. As described below, drugs may be modified by the incorporation of a functionally active group such as a thiol or amine group for conjugation to the antibody.

Exemplary maytansinoid drug moieties include those having a modified aromatic ring, such as: C-19-dechloro (U.S. Pat. No. 4,256,746) (prepared by lithium aluminum hydride reduction of ansamytocin P2); C-20-hydroxy (or C-20-demethyl)+/−C-19-dechloro (U.S. Pat. Nos. 4,361,650 and 4,307,016) (prepared by demethylation using *Streptomyces* or *Actinomyces* or dechlorination using LAH); and C-20-demethoxy, C-20-acyloxy (—OCOR), +/−dechloro (U.S. Pat. No. 4,294,757) (prepared by acylation using acyl chlorides) and those having modifications at other positions Exemplary maytansinoid drug moieties also include those having modifications such as: C-9-SH (U.S. Pat. No. 4,424, 219) (prepared by the reaction of maytansinol with H2S or P2S5); C-14-alkoxymethyl(demethoxy/CH2OR) (U.S. Pat. No. 4,331,598); C-14-hydroxymethyl or acyloxymethyl (CH2OH or CH2OAc) (U.S. Pat. No. 4,450,254) (prepared from *Nocardia*); C-15-hydroxy/acyloxy (U.S. Pat. No. 4,364,866) (prepared by the conversion of maytansinol by *Streptomyces*); C-15-methoxy (U.S. Pat. Nos. 4,313,946 and 4,315,929) (isolated from *Trewia nudlflora*); C-18-N-demethyl (U.S. Pat. Nos. 4,362,663 and 4,322,348) (prepared by the demethylation of maytansinol by *Streptomyces*); and 4,5-deoxy (U.S. Pat. No. 4,371,533) (prepared by the titanium trichloride/LAH reduction of maytansinol).

Of particular use are DM1 (disclosed in U.S. Pat. No. 5,208,020, incorporated by reference) and DM4 (disclosed in U.S. Pat. No. 7,276,497, incorporated by reference). See also a number of additional maytansinoid derivatives and methods in 5,416,064, WO/01/24763, 7,303,749, 7,601,354, U.S. Ser. No. 12/631,508, WO02/098883, 6,441,163, 7,368, 565, WO02/16368 and WO04/1033272, all of which are expressly incorporated by reference in their entirety.

ADCs containing maytansinoids, methods of making same, and their therapeutic use are disclosed, for example, in U.S. Pat. Nos. 5,208,020; 5,416,064; 6,441,163 and European Patent EP 0 425 235 B1, the disclosures of which are hereby expressly incorporated by reference. Liu et al., Proc. Natl. Acad. Sci. USA 93:8618-8623 (1996) described ADCs comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Chari et al., Cancer Research 52:127-131 (1992) describe ADCs in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses 3×105 HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Auristatins and Dolastatins

In some embodiments, the ADC comprises a multispecific antibody conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, disclosed in "Senter et al, Proceedings of the American Association for Cancer Research, Volume 45, Abstract Number 623, presented Mar. 28, 2004 and described in United States Patent Publication No. 2005/0238648, the disclosure of which is expressly incorporated by reference in its entirety.

An exemplary auristatin embodiment is MMAE (see U.S. Pat. No. 6,884,869 expressly incorporated by reference in its entirety).

Another exemplary auristatin embodiment is MMAF (see US 2005/0238649, 5,767,237 and 6,124,431, expressly incorporated by reference in their entirety).

Additional exemplary embodiments comprising MMAE or MMAF and various linker components (described further herein) have the following structures and abbreviations (wherein Ab means antibody and p is 1 to about 8):

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. Nos. 5,635,483; 5,780,588; Pettit et al (1989) J. Am. Chem. Soc. 111:5463-5465; Pettit et al (1998) Anti-Cancer Drug Design 13:243-277; Pettit, G. R., et al. Synthesis, 1996, 719-725; Pettit et al (1996) J. Chem. Soc. Perkin Trans. 1 5:859-863; and Doronina (2003) Nat Biotechnol 21(7):778-784.

Calicheamicin

In other embodiments, the ADC comprises an antibody of the invention conjugated to one or more calicheamicin molecules. For example, Mylotarg is the first commercial ADC drug and utilizes calicheamicin γ1 as the payload (see U.S. Pat. No. 4,970,198, incorporated by reference in its entirety). Additional calicheamicin derivatives are described in U.S. Pat. Nos. 5,264,586, 5,384,412, 5,550,246, 5,739, 116, 5,773,001, 5,767,285 and 5,877,296, all expressly incorporated by reference. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, γ1I, α2I, α2I, N-acetyl-γ1I, PSAG and θI1 (Hinman et al., Cancer Research 53:3336-3342 (1993), Lode et al., Cancer Research 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Duocarmycins

CC-1065 (see 4,169,888, incorporated by reference) and duocarmycins are members of a family of antitumor antibiotics utilized in ADCs. These antibiotics appear to work through sequence-selectively alkylating DNA at the N3 of adenine in the minor groove, which initiates a cascade of events that result in apoptosis.

Important members of the duocarmycins include duocarmycin A (U.S. Pat. No. 4,923,990, incorporated by reference) and duocarmycin SA (U.S. Pat. No. 5,101,038, incorporated by reference), and a large number of analogues as described in U.S. Pat. Nos. 7,517,903, 7,691,962, 5,101,038; 5,641,780; 5,187,186; 5,070,092; 5,070,092; 5,641,780; 5,101,038; 5,084,468, 5,475,092, 5,585,499, 5,846,545, WO2007/089149, WO2009/017394A1, 5,703,080, 6,989, 452, 7,087,600, 7,129,261, 7,498,302, and 7,507,420, all of which are expressly incorporated by reference.

Other Cytotoxic Agents

Other antitumor agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232 published Oct. 28, 1993.

The present invention further contemplates an ADC formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include At211, I131, I125, Y90, Re186, Re188, Sm153, Bi212, P32, Pb212 and radioactive isotopes of Lu.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as Tc99m or I123, Re186, Re188 and In111 can be attached via a cysteine residue in the peptide. Yttrium-90 can be attached via a lysine residue. The IODOGEN method (Fraker et al (1978) Biochem. Biophys. Res. Commun 80: 49-57 can be used to incorporate Iodine-123. "Monoclonal Antibodies in Immunoscintigraphy" (Chatal, CRC Press 1989) describes other methods in detail.

For compositions comprising a plurality of antibodies, the drug loading is represented by p, the average number of drug molecules per Antibody. Drug loading may range from 1 to 20 drugs (D) per Antibody. The average number of drugs per antibody in preparation of conjugation reactions may be characterized by conventional means such as mass spectroscopy, ELISA assay, and HPLC. The quantitative distribution of Antibody-Drug-Conjugates in terms of p may also be determined.

In some instances, separation, purification, and characterization of homogeneous Antibody-Drug-conjugates where p is a certain value from Antibody-Drug-Conjugates with other drug loadings may be achieved by means such as reverse phase HPLC or electrophoresis. In exemplary embodiments, p is 2, 3, 4, 5, 6, 7, or 8 or a fraction thereof.

The generation of Antibody-drug conjugate compounds can be accomplished by any technique known to the skilled artisan. Briefly, the Antibody-drug conjugate compounds can include a multispecific antibody as the Antibody unit, a drug, and optionally a linker that joins the drug and the binding agent.

A number of different reactions are available for covalent attachment of drugs and/or linkers to binding agents. This is can be accomplished by reaction of the amino acid residues of the binding agent, for example, antibody molecule, including the amine groups of lysine, the free carboxylic acid groups of glutamic and aspartic acid, the sulfhydryl groups of cysteine and the various moieties of the aromatic amino acids. A commonly used non-specific methods of covalent attachment is the carbodiimide reaction to link a carboxy (or amino) group of a compound to amino (or carboxy) groups of the antibody. Additionally, bifunctional agents such as dialdehydes or imidoesters have been used to link the amino group of a compound to amino groups of an antibody molecule.

Also available for attachment of drugs to binding agents is the Schiff base reaction. This method involves the periodate oxidation of a drug that contains glycol or hydroxy groups, thus forming an aldehyde which is then reacted with the binding agent. Attachment occurs via formation of a Schiff base with amino groups of the binding agent. Isothiocyanates can also be used as coupling agents for covalently attaching drugs to binding agents. Other techniques are known to the skilled artisan and within the scope of the present invention.

In some embodiments, an intermediate, which is the precursor of the linker, is reacted with the drug under appropriate conditions. In other embodiments, reactive groups are used on the drug and/or the intermediate. The product of the reaction between the drug and the intermediate, or the derivatized drug, is subsequently reacted with an multispecific antibody of the invention under appropriate conditions.

It will be understood that chemical modifications may also be made to the desired compound in order to make reactions of that compound more convenient for purposes of preparing conjugates of the invention. For example a functional group e g amine, hydroxyl, or sulfhydryl, may be appended to the drug at a position which has minimal or an acceptable effect on the activity or other properties of the drug Linker Units Typically, the antibody-drug conjugate compounds comprise a Linker unit between the drug unit and the antibody unit. In some embodiments, the linker is cleavable under intracellular or extracellular conditions, such that cleavage of the linker releases the drug unit from the antibody in the appropriate environment. For example, solid tumors that secrete certain proteases may serve as the target of the cleavable linker; in other embodiments, it is the intracellular proteases that are utilized. In yet other embodiments, the linker unit is not cleavable and the drug is released, for example, by antibody degradation in lysosomes.

In some embodiments, the linker is cleavable by a cleaving agent that is present in the intracellular environment (for example, within a lysosome or endosome or caveolea). The linker can be, for example, a peptidyl linker that is cleaved by an intracellular peptidase or protease enzyme, including, but not limited to, a lysosomal or endosomal protease. In some embodiments, the peptidyl linker is at least two amino acids long or at least three amino acids long or more.

Cleaving agents can include, without limitation, cathepsins B and D and plasmin, all of which are known to hydrolyze dipeptide drug derivatives resulting in the release of active drug inside target cells (see, e.g., Dubowchik and Walker, 1999, Pharm. Therapeutics 83:67-123). Peptidyl linkers that are cleavable by enzymes that are present in CD38-expressing cells. For example, a peptidyl linker that is cleavable by the thiol-dependent protease cathepsin-B, which is highly expressed in cancerous tissue, can be used (e.g., a Phe-Leu or a Gly-Phe-Leu-Gly linker (SEQ ID NO: 460)). Other examples of such linkers are described, e.g., in U.S. Pat. No. 6,214,345, incorporated herein by reference in its entirety and for all purposes.

In some embodiments, the peptidyl linker cleavable by an intracellular protease is a Val-Cit linker or a Phe-Lys linker (see, e.g., U.S. Pat. No. 6,214,345, which describes the synthesis of doxorubicin with the val-cit linker).

In other embodiments, the cleavable linker is pH-sensitive, that is, sensitive to hydrolysis at certain pH values. Typically, the pH-sensitive linker hydrolyzable under acidic conditions. For example, an acid-labile linker that is hydrolyzable in the lysosome (for example, a hydrazone, semicarbazone, thiosemicarbazone, cis-aconitic amide, orthoester, acetal, ketal, or the like) may be used. (See, e.g., U.S. Pat. Nos. 5,122,368; 5,824,805; 5,622,929; Dubowchik and Walker, 1999, Pharm. Therapeutics 83:67-123; Neville et al., 1989, Biol. Chem. 264:14653-14661.) Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929).

In yet other embodiments, the linker is cleavable under reducing conditions (for example, a disulfide linker). A variety of disulfide linkers are known in the art, including, for example, those that can be formed using SATA (N-succinimidyl-5-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio)toluene)-, SPDB and SMPT. (See, e.g., Thorpe et al., 1987, Cancer Res. 47:5924-5931; Wawrzynczak et al., In Immunoconjugates: Antibody Conjugates in Radioimagery and Therapy of Cancer (C. W. Vogel ed., Oxford U. Press, 1987. See also U.S. Pat. No. 4,880,935.)

In other embodiments, the linker is a malonate linker (Johnson et al., 1995, Anticancer Res. 15:1387-93), a maleimidobenzoyl linker (Lau et al., 1995, Bioorg-Med-Chem. 3(10):1299-1304), or a 3'-N-amide analog (Lau et al., 1995, Bioorg-Med-Chem. 3(10):1305-12).

In yet other embodiments, the linker unit is not cleavable and the drug is released by antibody degradation. (See U.S. Publication No. 2005/0238649 incorporated by reference herein in its entirety and for all purposes).

In many embodiments, the linker is self-immolative. As used herein, the term "self-immolative Spacer" refers to a bifunctional chemical moiety that is capable of covalently linking together two spaced chemical moieties into a stable tripartite molecule. It will spontaneously separate from the second chemical moiety if its bond to the first moiety is cleaved. See for example, WO 2007059404A2, WO06110476A2, WO05112919A2, WO2010/062171, WO09/017394, WO07/089149, WO 07/018431, WO04/043493 and WO02/083180, which are directed to drug-cleavable substrate conjugates where the drug and cleavable substrate are optionally linked through a self-immolative linker and which are all expressly incorporated by reference.

Often the linker is not substantially sensitive to the extracellular environment. As used herein, "not substantially sensitive to the extracellular environment," in the context of a linker, means that no more than about 20%, 15%, 10%, 5%, 3%, or no more than about 1% of the linkers, in a sample of antibody-drug conjugate compound, are cleaved when the antibody-drug conjugate compound presents in an extracellular environment (for example, in plasma).

Whether a linker is not substantially sensitive to the extracellular environment can be determined, for example, by incubating with plasma the antibody-drug conjugate compound for a predetermined time period (for example, 2, 4, 8, 16, or 24 hours) and then quantitating the amount of free drug present in the plasma.

In other, non-mutually exclusive embodiments, the linker promotes cellular internalization. In certain embodiments, the linker promotes cellular internalization when conjugated to the therapeutic agent (that is, in the milieu of the linker-therapeutic agent moiety of the antibody-drug conjugate compound as described herein). In yet other embodiments, the linker promotes cellular internalization when conjugated to both the auristatin compound and the multispecific antibodies of the invention.

A variety of exemplary linkers that can be used with the present compositions and methods are described in WO 2004-010957, U.S. Publication No. 2006/0074008, U.S. Publication No. 20050238649, and U.S. Publication No. 2006/0024317 (each of which is incorporated by reference herein in its entirety and for all purposes).

Drug Loading

Drug loading is represented by p and is the average number of Drug moieties per antibody in a molecule. Drug loading ("p") may be 1, 2, 3, 4, 5, 6, 7, 8, 9, 10, 11, 12, 13, 14, 15, 16, 17, 18, 19, 20 or more moieties (D) per antibody, although frequently the average number is a fraction or a decimal. Generally, drug loading of from 1 to 4 is frequently useful, and from 1 to 2 is also useful. ADCs of the invention include collections of antibodies conjugated with a range of drug moieties, from 1 to 20. The average number of drug moieties per antibody in preparations of ADC from conjugation reactions may be characterized by conventional means such as mass spectroscopy and, ELISA assay.

The quantitative distribution of ADC in terms of p may also be determined. In some instances, separation, purification, and characterization of homogeneous ADC where p is a certain value from ADC with other drug loadings may be achieved by means such as electrophoresis.

For some antibody-drug conjugates, p may be limited by the number of attachment sites on the antibody. For example, where the attachment is a cysteine thiol, as in the exemplary embodiments above, an antibody may have only one or several cysteine thiol groups, or may have only one or several sufficiently reactive thiol groups through which a linker may be attached. In certain embodiments, higher drug loading, e.g. p>5, may cause aggregation, insolubility, toxicity, or loss of cellular permeability of certain antibody-drug conjugates. In certain embodiments, the drug loading for an ADC of the invention ranges from 1 to about 8; from about 2 to about 6; from about 3 to about 5; from about 3 to about 4; from about 3.1 to about 3.9; from about 3.2 to about 3.8; from about 3.2 to about 3.7; from about 3.2 to about 3.6; from about 3.3 to about 3.8; or from about 3.3 to about 3.7. Indeed, it has been shown that for certain ADCs, the optimal ratio of drug moieties per antibody may be less than 8, and may be about 2 to about 5. See US 2005-0238649 A1 (herein incorporated by reference in its entirety).

In certain embodiments, fewer than the theoretical maximum of drug moieties are conjugated to an antibody during a conjugation reaction. An antibody may contain, for example, lysine residues that do not react with the drug-linker intermediate or linker reagent, as discussed below. Generally, antibodies do not contain many free and reactive cysteine thiol groups which may be linked to a drug moiety; indeed most cysteine thiol residues in antibodies exist as disulfide bridges. In certain embodiments, an antibody may be reduced with a reducing agent such as dithiothreitol (DTT) or tricarbonylethylphosphine (TCEP), under partial or total reducing conditions, to generate reactive cysteine thiol groups. In certain embodiments, an antibody is subjected to denaturing conditions to reveal reactive nucleophilic groups such as lysine or cysteine.

The loading (drug/antibody ratio) of an ADC may be controlled in different ways, e.g., by: (i) limiting the molar excess of drug-linker intermediate or linker reagent relative to antibody, (ii) limiting the conjugation reaction time or temperature, (iii) partial or limiting reductive conditions for cysteine thiol modification, (iv) engineering by recombinant techniques the amino acid sequence of the antibody such that the number and position of cysteine residues is modified for control of the number and/or position of linker-drug attachments (such as thioMab or thioFab prepared as disclosed herein and in WO2006/034488 (herein incorporated by reference in its entirety)).

It is to be understood that where more than one nucleophilic group reacts with a drug-linker intermediate or linker reagent followed by drug moiety reagent, then the resulting product is a mixture of ADC compounds with a distribution of one or more drug moieties attached to an antibody. The average number of drugs per antibody may be calculated from the mixture by a dual ELISA antibody assay, which is specific for antibody and specific for the drug. Individual ADC molecules may be identified in the mixture by mass spectroscopy and separated by HPLC, e.g. hydrophobic interaction chromatography.

In some embodiments, a homogeneous ADC with a single loading value may be isolated from the conjugation mixture by electrophoresis or chromatography.

Methods of Determining Cytotoxic Effect of ADCs

Methods of determining whether a Drug or Antibody-Drug conjugate exerts a cytostatic and/or cytotoxic effect on a cell are known. Generally, the cytotoxic or cytostatic activity of an Antibody Drug conjugate can be measured by: exposing mammalian cells expressing a target protein of the Antibody Drug conjugate in a cell culture medium; culturing the cells for a period from about 6 hours to about 5 days; and measuring cell viability. Cell-based in vitro assays can be used to measure viability (proliferation), cytotoxicity, and induction of apoptosis (caspase activation) of the Antibody Drug conjugate.

For determining whether an Antibody Drug conjugate exerts a cytostatic effect, a thymidine incorporation assay may be used. For example, cancer cells expressing a target antigen at a density of 5,000 cells/well of a 96-well plated can be cultured for a 72-hour period and exposed to 0.5 µCi of 3H-thymidine during the final 8 hours of the 72-hour period. The incorporation of 3H-thymidine into cells of the culture is measured in the presence and absence of the Antibody Drug conjugate.

For determining cytotoxicity, necrosis or apoptosis (programmed cell death) can be measured. Necrosis is typically accompanied by increased permeability of the plasma membrane; swelling of the cell, and rupture of the plasma membrane. Apoptosis is typically characterized by membrane blebbing, condensation of cytoplasm, and the activation of endogenous endonucleases. Determination of any of these effects on cancer cells indicates that an Antibody Drug conjugate is useful in the treatment of cancers.

Cell viability can be measured by determining in a cell the uptake of a dye such as neutral red, trypan blue, or ALA-MAR™ blue (see, e.g., Page et al., 1993, Intl. J. Oncology 3:473-476). In such an assay, the cells are incubated in media containing the dye, the cells are washed, and the remaining dye, reflecting cellular uptake of the dye, is measured spectrophotometrically. The protein-binding dye sulforhodamine B (SRB) can also be used to measure cytotoxicity (Skehan et al., 1990, J. Natl. Cancer Inst. 82:1107-12).

Alternatively, a tetrazolium salt, such as MTT, is used in a quantitative colorimetric assay for mammalian cell survival and proliferation by detecting living, but not dead, cells (see, e.g., Mosmann, 1983, J. Immunol. Methods 65:55-63).

Apoptosis can be quantitated by measuring, for example, DNA fragmentation. Commercial photometric methods for the quantitative in vitro determination of DNA fragmentation are available. Examples of such assays, including TUNEL (which detects incorporation of labeled nucleotides in fragmented DNA) and ELISA-based assays, are described in Biochemica, 1999, no. 2, pp. 34-37 (Roche Molecular Biochemicals).

Apoptosis can also be determined by measuring morphological changes in a cell. For example, as with necrosis, loss of plasma membrane integrity can be determined by measuring uptake of certain dyes (e.g., a fluorescent dye such as, for example, acridine orange or ethidium bromide). A method for measuring apoptotic cell number has been described by Duke and Cohen, Current Protocols in Immunology (Coligan et al. eds., 1992, pp. 3.17.1-3.17.16). Cells also can be labeled with a DNA dye (e.g., acridine orange, ethidium bromide, or propidium iodide) and the cells observed for chromatin condensation and margination along the inner nuclear membrane. Other morphological changes that can be measured to determine apoptosis include, e.g., cytoplasmic condensation, increased membrane blebbing, and cellular shrinkage.

The presence of apoptotic cells can be measured in both the attached and "floating" compartments of the cultures. For example, both compartments can be collected by removing the supernatant, trypsinizing the attached cells, combining the preparations following a centrifugation wash step (e.g., 10 minutes at 2000 rpm), and detecting apoptosis (e.g., by measuring DNA fragmentation). (See, e.g., Piazza et al., 1995, Cancer Research 55:3110-16).

In vivo, the effect of a therapeutic composition of the multispecific antibody of the invention can be evaluated in a suitable animal model. For example, xenogenic cancer models can be used, wherein cancer explants or passaged xenograft tissues are introduced into immune compromised animals, such as nude or SCID mice (Klein et al., 1997, Nature Medicine 3: 402-408). Efficacy can be measured using assays that measure inhibition of tumor formation, tumor regression or metastasis, and the like.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specificities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and gamma ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Thus for B cell tumors, the subject may experience a decrease in the so-called B symptoms, i.e., night sweats, fever, weight loss, and/or urticaria. For pre-malignant conditions, therapy with an multispecific therapeutic agent may block and/or prolong the time before development of a related malignant condition, for example, development of multiple myeloma in subjects suffering from monoclonal gammopathy of undetermined significance (MGUS).

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the multispecific antibodies used in the present invention depend on the disease or condition to be treated and may be determined by the persons skilled in the art.

An exemplary, non-limiting range for a therapeutically effective amount of an multispecific antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, the antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the multispecific antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the multispecific antibody is administered by slow continuous infusion over a long period, such as more than 24 hours, if required to reduce side effects including toxicity.

In one embodiment the multispecific antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the multispecific antibody.

In a further embodiment, the multispecific antibody is administered once weekly for 2 to 12 weeks, such as for 3 to 10 weeks, such as for 4 to 8 weeks.

In one embodiment, the multispecific antibody is administered by maintenance therapy, such as, e.g., once a week for a period of 6 months or more.

In one embodiment, the multispecific antibody is administered by a regimen including one infusion of an multispecific antibody followed by an infusion of an multispecific antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the multispecific antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, overexpressed or activated in cancers, the inhibition of which downregulates cell replication.

In some embodiments, the antibodies of the invention can be used prior to, concurrent with, or after treatment with Velcade® (bortezomib).

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

Example 1

Prototype "Triple F" Bispecific Antibody

Figure 2:
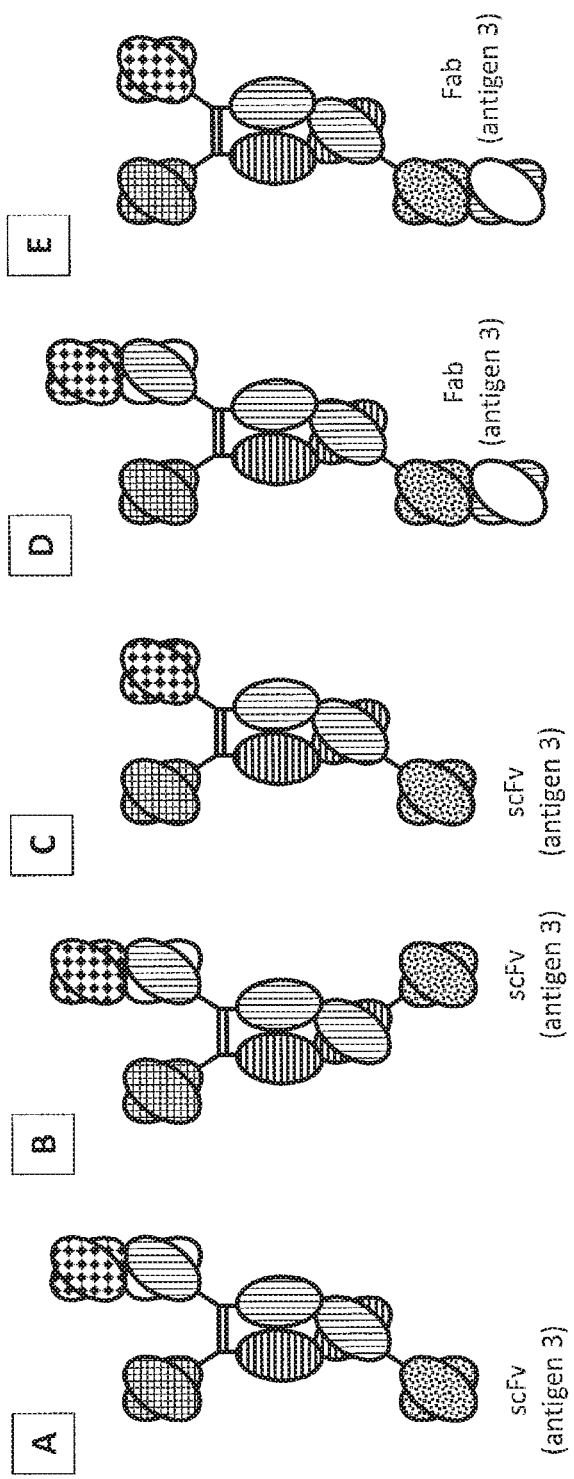
FIGS. 2A-2E depict a variety of "higher multispecificity" embodiments of the present invention.

The present invention describes novel immunoglobulin compositions that co-engage a first and second antigen. One heavy chain of the antibody contains a single chain Fv ("scFv", as defined herein) and the other heavy chain is a "regular" Fab format, comprising a variable heavy chain and a light chain (see FIG. 1). This structure is sometimes referred to herein as "triple F" format (scFv-Fab-Fc). The two chains are brought together by the dimeric Fc region (see FIG. 2). The Fc region can be modified by amino acid substitution to allow for efficient purification of the "triple F" heterodimer. Further, the Fc region can be modified by amino acid substitution to promote the formation of the "triple F" heterodimer Examples of Fc substitutions are described more fully below.

Figure 3:
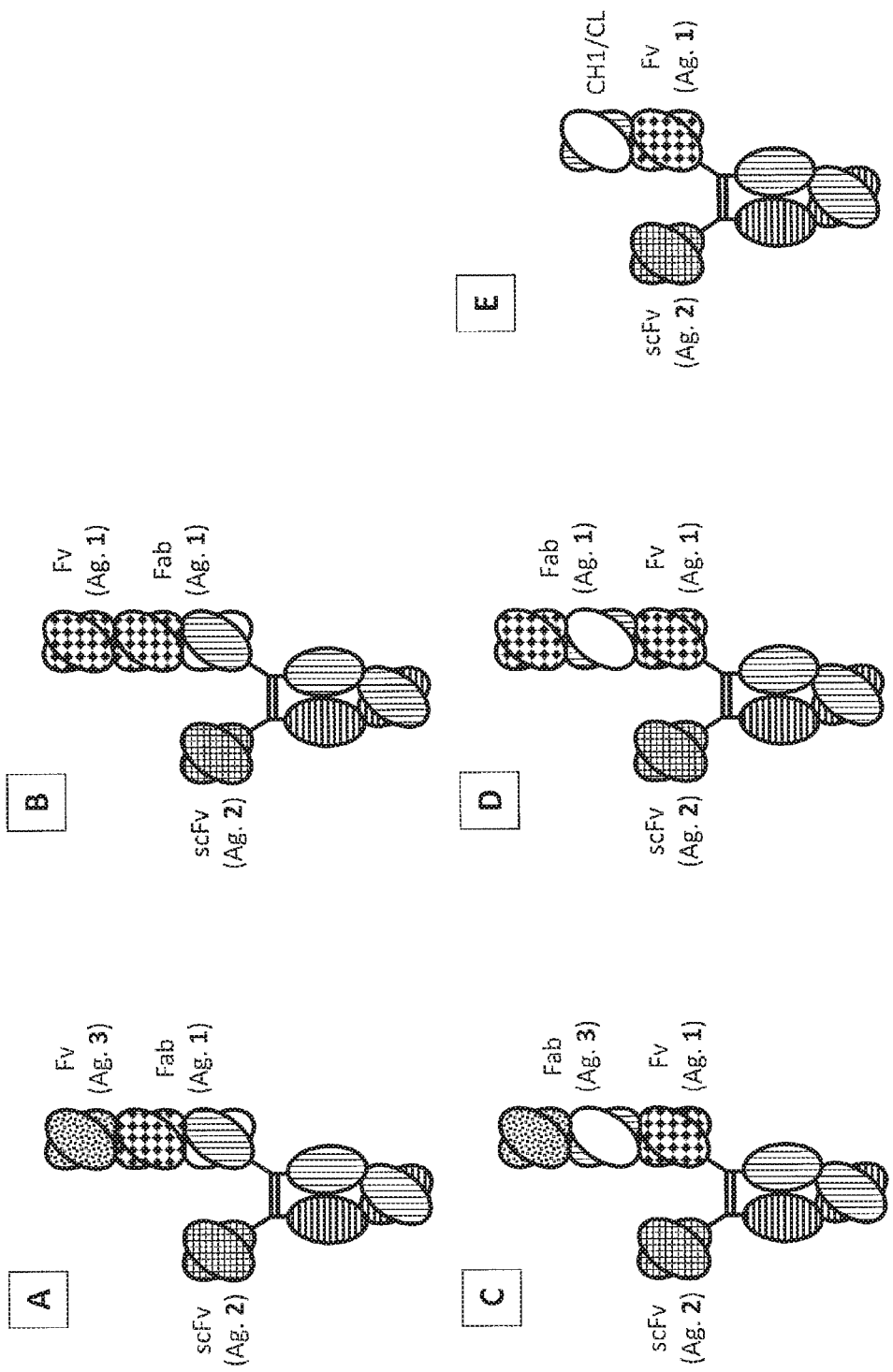
FIGS. 3A-3E show additional varieties of "higher multispecificity" embodiments of the "triple F" format, all with one monomer comprising an scFv and all of which have molecular weight differentials which can be exploited for purification of the heterodimers).

Fc substitutions can be included in the "triple F" format to allow for efficient purification of the desired "triple F" heterodimer over the undesired dual scFv-Fc and mAb homodimers. An example of this is in the inclusion of Fc substitutions that alter the isoelectric point (pI) of each monomer so that such that each monomer has a different pI. In this case the desired "triple F" heterodimer will have a different pI than that of the undesired dual scFv-Fc and mAb homodimers, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns). See FIG. 3 for a list of substitutions that can be made in Fc monomer 1 and Fc monomer 2 to allow for efficient purification of the desired "triple F" heterodimer.

Fc substitutions can be included in the "triple F" format to "skew" the formation toward the desired "triple F" heterodimer over the undesired dual scFv-Fc and mAb homodimers. For example, see FIG. 4 for a list of substitutions that can be made in Fc monomer 1 and Fc monomer 2 to "skew" production toward the "triple F" heterodimer. Amino acid substitutions listed in FIG. 3 and FIG. 4 can be combined, leading to an increased yield of "triple F" heterodimer that can be easily purified away from any contaminating dual scFv-Fc and mAb homodimers.

After optimization of an scFv domain for inclusion in the "triple F" format, an optimized scFv domain can be coupled with a variety of standard antibody heavy chains in a convenient fashion. For example, an anti-CD3 scFv for recruiting T cell cytotoxicity can be coupled with a variety of anti-tumor antigen antibody heavy chains (e.g., those binding CD5, CD20, CD30, CD40, CD33, CD38, EGFR, EpCAM, Her2, HM1.24, or other tumor antigen). Further examples of optimized scFv domains that can be conveniently coupled with standard antibody heavy chains include anti-CD16 scFv for natural killer cell cytotoxicity; anti-CD32b scFv for inhibitory activity (here the coupled antibody heavy chain would bind, e.g., CD19, CD40, CD79a, CD79b, or other immune receptors); and anti-transferrin receptor scFv, anti-insulin receptor, or anti-LRP1 for transport across the blood-brain barrier.

Example 2

Multi-Specific Antibodies Derived from the "Triple F" Format

Multi-specific antibodies can be constructed by attaching additional scFv or Fab domains that bind a third antigen to the C-terminus of one of the "triple F" heavy chains. See FIG. 5 for examples. Alternatively, the C-terminal scFv or Fab may bind the first or second antigen, thus conferring bivalency and an increase in overall binding affinity for that antigen.

Multi-specific antibodies can also be constructed by coupling the scFv-Fc heavy chain of the "triple F" format may with rearranged antibody heavy chains as depicted in FIG. 6. Such rearranged heavy chains may include an additional Fv region that binds a third antigen or an additional Fv region that binds the first antigen or second antigen, thus conferring bivalency and an increase in overall binding affinity for that antigen.

Example 3

Anti-CD19 Fab×Anti-CD3 scFv "Triple F" Bispecific

Amino acid sequences for anti-CD19 Fab×anti-CD3 scFv "triple F" bispecifics are listed in the figures. Amino acid substitutions made to allow for efficient purification of the desired "triple F" heterodimer over the undesired dual scFv-Fc and mAb homodimers are underlined Amino acid sequences for preferred humanized anti-CD3 variable regions are listed in FIGS. 2 and 6 (with CDRs underlined). Some examples of expression and purification of the desired "triple F" species and its bioactivity are given below.

Figure 9:
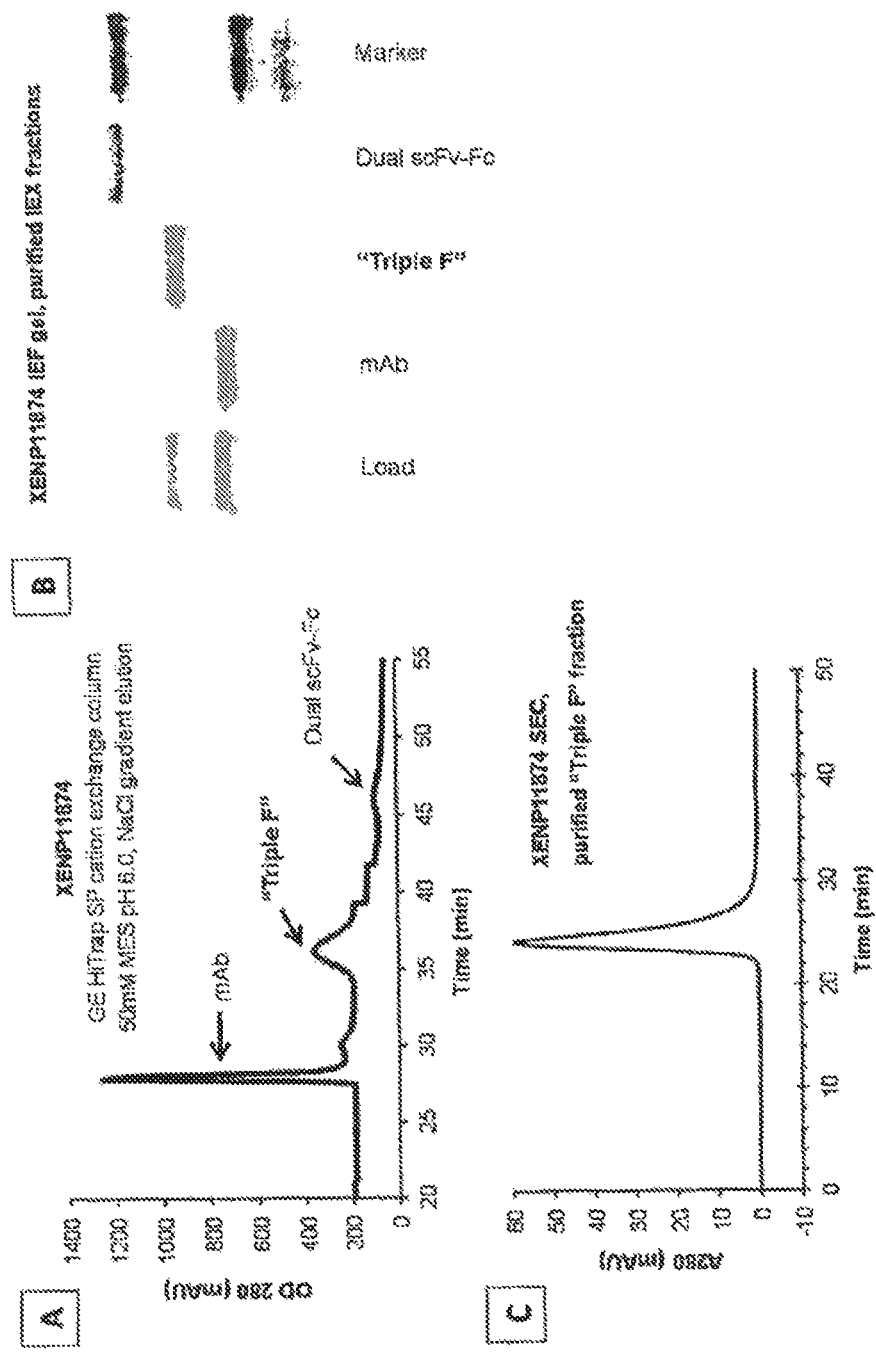
FIGS. 9A, 9B and 9C. Production of XENP11874, a "triple F" bispecific with an anti-CD19 Fab and anti-CD3 scFv.

The production of XENP11874, a "triple F" bispecific with an anti-CD 19 Fab and anti-CD3 scFv, is outlined in FIG. 9. In FIG. 9A, the ion exchange purification of the desired "triple F" heterodimer from the undesired dual scFv-Fc and mAb homodimers is shown. The purity of the "triple F" fraction was checked by IEF gel, (data shown in FIG. 9B of U.S. Ser. No. 61/818,410, all figures and legends of which are expressly incorporated by reference). Finally, SEC was used to confirm the homogenous size of the "triple F" product (data shown in FIG. 9C of U.S. Ser. No. 61/818,410, expressly incorporated by reference).

Figure 10:
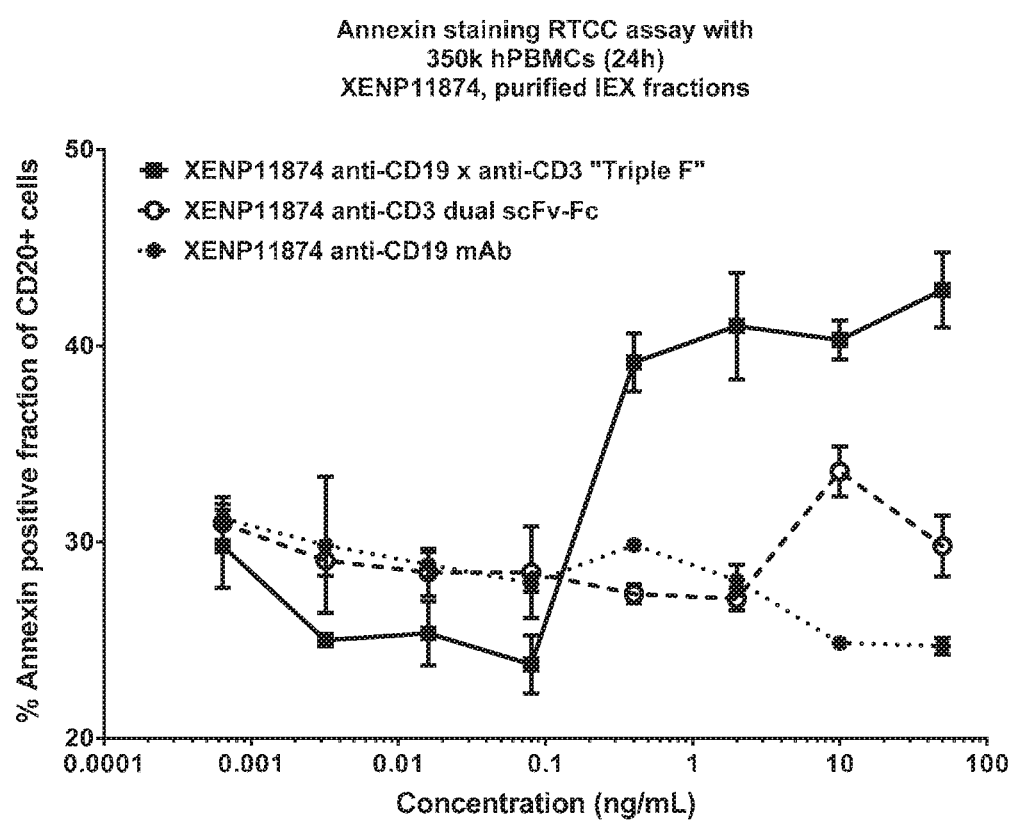
FIG. 10. XENP11874, anti-CD19 Fab×anti-CD3 scFv "triple F" bispecific, potently recruits T cells for B cell depletion.

XENP11874, anti-CD19 Fab×anti-CD3 scFv "triple F" bispecific, was shown to have potent bioactivity. The ability of XENP11874 to potently recruit T cells for B cell depletion is shown in FIG. 10 of U.S. Ser. No. 61/818,410, expressly incorporated by reference).

The production of XENP11924, a "triple F" bispecific with an anti-CD 19 Fab and anti-CD3 scFv, is outlined in FIG. 11 of U.S. Ser. No. 61/818,410, expressly incorporated by reference. In FIG. 11A of U.S. Ser. No. 61/818,410, the ion exchange purification of the desired "triple F" heterodimer from the undesired dual scFv-Fc and mAb homodimers is shown. The purity of the "triple F" fraction was checked by IEF gel, shown in FIG. 11B (of U.S. Ser. No. 61/818, 410). Finally, SEC was used to confirm the homogenous size of the "triple F" product (see FIG. 11C of U.S. Ser. No. 61/818,410).

XENP11924, anti-CD19 Fab×anti-CD3 scFv "triple F" bispecific, was shown to have potent bioactivity. The ability of XENP11924 to potently recruit T cells for the killing of the Raji tumor cell line is shown in FIG. 12 of U.S. Ser. No. 61/818,410.

Example 4

Anti-CD38 Fab×Anti-CD3 scFv "Triple F" Bispecific

Amino acid sequences for anti-CD38 Fab×anti-CD3 scFv "triple F" bispecifics are listed in FIG. 13 of U.S. Ser. No. 61/818,410. Amino acid substitutions made to allow for efficient purification of the desired "triple F" heterodimer over the undesired dual scFv-Fc and mAb homodimers are underlined. Some examples of expression and purification of the desired "triple F" species and its bioactivity are given below.

Figure 14:
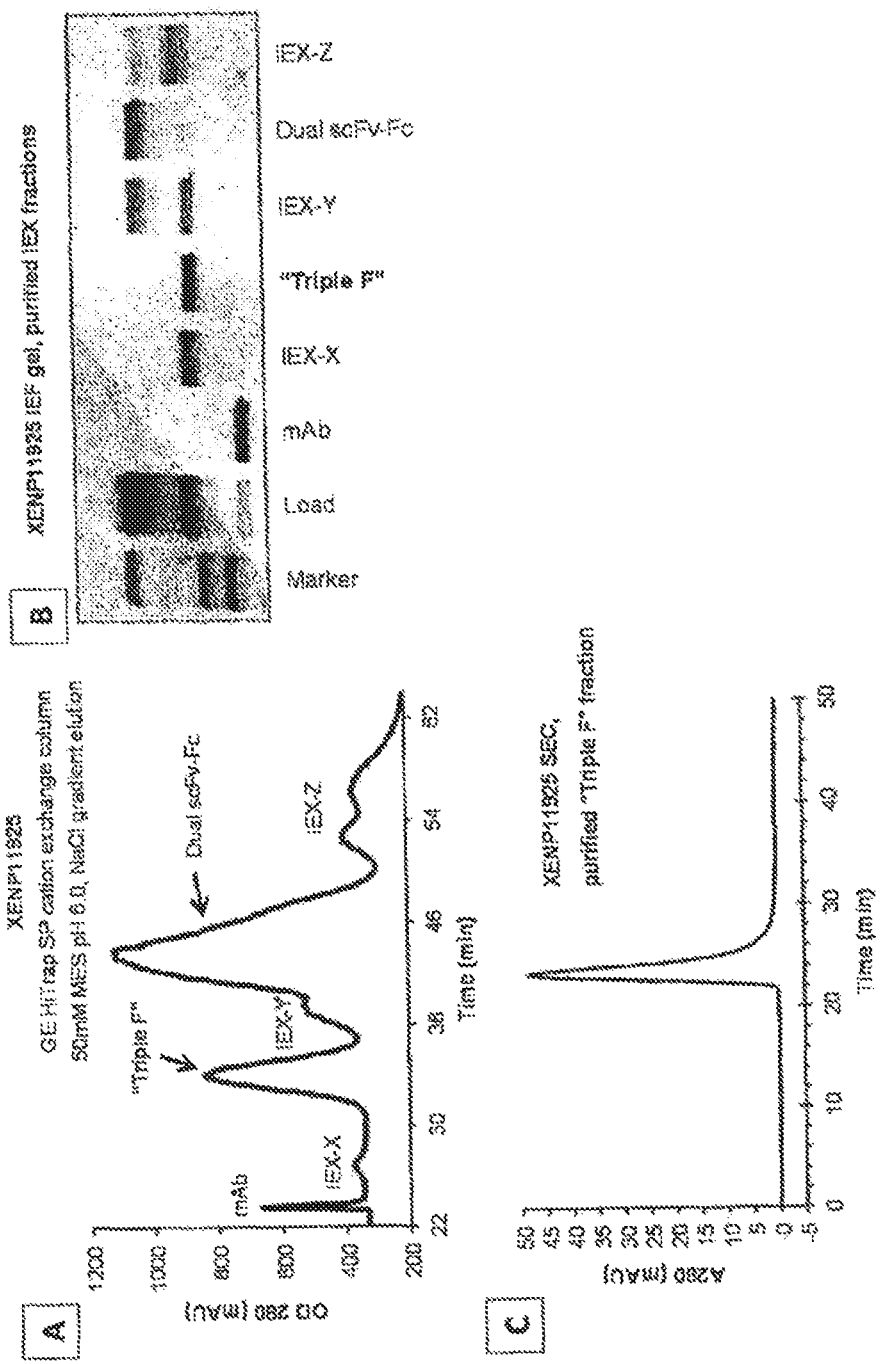

The production of XENP11925, a "triple F" bispecific with an anti-CD38 Fab and anti-CD3 scFv, is outlined in FIG. 14 of U.S. Ser. No. 61/818,410. In FIG. 14A of U.S. Ser. No. 61/818,410, the ion exchange purification of the desired "triple F" heterodimer from the undesired dual scFv-Fc and mAb homodimers is shown. The purity of the "triple F" fraction was checked by IEF gel, shown in FIG. 14B of U.S. Ser. No. 61/818,410. Finally, SEC was used to confirm the homogenous size of the "triple F" product (see FIG. 14C of U.S. Ser. No. 61/818,410).

XENP11925, anti-CD38 Fab×anti-CD3 scFv "triple F" bispecific, was shown to have potent bioactivity. The ability of XENP11925 to potently recruit T cells for the killing of the RPMI8226 tumor cell line is shown in FIG. 15 of U.S. Ser. No. 61/818,410.

Example 5

Identification and Repair of Destabilizing pI-Altering Isotypic Constant Region Variants As described above, efforts can be made to minimize the risk that substitutions that increase or decrease pI will elicit immunogenicity by utilizing the isotypic differences between the IgG subclasses (IgG1, IgG2, IgG3, and IgG4). A new set of novel isotypes was designed based on this principle. These new variants are called ISO(-), ISO(+), and ISO(+RR). The thermal stability of these novel isotypes were determined in a Hinge-CH2-CH3 (H-CH2-CH3) system (Fc region only). Proteins were expressed and purified as described above. Sequences for this proof-of-concept system are listed in FIG. 16.

Thermal stability measurements (FIG. 17) determined by differential scanning calorimetry (DSC) revealed that the ISO(-)/ISO(+RR) heterodimer (XENP12488, see FIG. 16 for sequence) was less stable than wild-type IgG1 (XENP8156, see FIG. 16 for sequence). Subsequent engineering efforts identified substitutions N384S/K392N/M397V in the ISO(-) heavy chain as the source of the destabilization. As a result, the variant designated ISO(-NKV) was designed and tested (see FIG. 16). In this variant, positions 384, 392, and 397 were reverted to wild-type IgG1 (S384N/N392K/M397V). The thermal stability of the ISO (-NKV)/ISO(+RR) heterodimer (XENP12757, see FIG. 16 for sequence) was measured by DSC and found to be equivalent to that of wild-type IgG1 (FIG. 17). This result underscores the importance of choosing or not choosing particular pI-altering isotypic substitutions to avoid those that are destabilizing.

Example 6

Additional Heterodimer-Skewing Fc Variants

As described above, heterodimer-skewing Fc variants can be made to bias toward the formation of the desired heterodimer versus the undesired homodimers. Additional heterodimer-skewing Fc variants L368D/K370S-S364K/E357Q (XENP12760, see FIG. 18 for sequence) were designed and tested in a Hinge-CH2-CH3 system (Fc region only). Protein was expressed and purified as described above.

The proteins present after only a single standard protein A purification step were examined by high-performance liquid chromatography (HPLC) using a cation exchange (CIEX) column (see FIG. 19). This allowed the determination of the yield of desired heterodimer versus undesired homodimers. The presence of the L368D/K370S-S364K/E357Q variant (XENP12760, FIG. 19, bottom panel) introduced an extreme bias toward the desired formation of heterodimer compared against the absence of this variant (XENP12757, FIG. 19, top panel). Note that heterodimer yield is 95.8% with the L368D/K370S-S364K/E357Q variant versus only 52.7% without.

Additional heterodimer-skewing Fc variants were also designed and tested. FIG. 36 provides a list of engineered heterodimer-skewing Fc variants with heterodimer yields (determined by HPLC-CIEX) and thermal stabilities (determined by DSC). The L368D/K370S-S364K/E357Q variant with high heterodimer yield and high thermal stability is especially preferred.

Example 7

Additional Heterodimer-Skewing Fc Variants in the Fab-scFv-Fc Context

Heterodimer-skewing Fc variants L368D/K370S-S364K/E357Q were engineered into an anti-CD19×anti-CD3 Fab-scFv-Fc (see FIG. 15 for amino acid sequences). Control Fab-scFv-Fc XENP13228 lacked these heterodimer-skewing Fc variants. The proteins present after only a single standard protein A purification step were examined by an isoelectric focusing (IEF) gel. This allowed the determination of the yield of desired heterodimer versus undesired homodimers. The presence of the L368D/K370S-S364K/E357Q variant (XENP13122, FIG. 22, right lane) introduced an extreme bias toward the desired formation of heterodimer (center band) compared against the absence of this variant (XENP13228, FIG. 22, left lane).

SEQUENCE LISTING (481 sequences)

SEQ ID NO: 1 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 2 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 3 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 4 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 5 - protein, 125 aa, Artificial Sequence; identical to SEQ ID NO: 1
  synthetic sequence

SEQ ID NO: 6 - protein, 109 aa, Artificial Sequence; identical to SEQ ID NO: 2
  synthetic sequence

SEQ ID NO: 7 - protein, 257 aa, Artificial Sequence
  synthetic sequence
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 8 - protein, 249 aa, Artificial Sequence
  synthetic sequence
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 9 - protein, 125 aa, Artificial Sequence
  synthetic sequence
EVQLVESGGGDVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 10 - protein, 109 aa, Artificial Sequence; identical to SEQ ID NO: 2
  synthetic sequence

SEQ ID NO: 11 - protein, 257 aa, Artificial Sequence
  synthetic sequence
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 12 - protein, 249 aa, Artificial Sequence
  synthetic sequence
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 13 - protein, 125 aa, Artificial Sequence
  synthetic sequence
EVQLVESGGGKVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 14 - protein, 109 aa, Artificial Sequence; identical to SEQ ID NO: 2
  synthetic sequence

SEQ ID NO: 15 - protein, 257 aa, Artificial Sequence
  synthetic sequence
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 16 - protein, 249 aa, Artificial Sequence
  synthetic sequence
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 17 - protein, 125 aa, Artificial Sequence
  synthetic sequence
EVQLVESGGGNVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 18 - protein, 109 aa, Artificial Sequence; identical to SEQ ID NO: 2
  synthetic sequence

SEQ ID NO: 19 - protein, 257 aa, Artificial Sequence
  synthetic sequence
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 20 - protein, 249 aa, Artificial Sequence
  synthetic sequence
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 21 - protein, 125 aa, Artificial Sequence
  synthetic sequence
EVQLVESGGGSVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 22 - protein, 109 aa, Artificial Sequence; identical to SEQ ID NO: 2
  synthetic sequence

SEQ ID NO: 23 - protein, 257 aa, Artificial Sequence
  synthetic sequence
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 24 - protein, 249 aa, Artificial Sequence
  synthetic sequence
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 25 - protein, 125 aa, Artificial Sequence
  synthetic sequence
EVQLVESGGGLVQPGGSLKLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 26 - protein, 109 aa, Artificial Sequence; identical to SEQ ID NO: 2
  synthetic sequence

SEQ ID NO: 27 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 28 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 29 - protein, 125 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 30 - protein, 109 aa, Artificial Sequence; identical to SEQ ID NO: 2
  synthetic sequence

SEQ ID NO: 31 - protein, 257 aa, Artificial Sequence
  synthetic sequence
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 32 - protein, 249 aa, Artificial Sequence
  synthetic sequence
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 33 - protein, 125 aa, Artificial Sequence
  synthetic sequence
EVQLVESGGGLVQPGGSLRLSCAASGFTFNTYAMHWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 34 - protein, 109 aa, Artificial Sequence; identical to SEQ ID NO: 2
  synthetic sequence

SEQ ID NO: 35 - protein, 257 aa, Artificial Sequence
  synthetic sequence
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 36 - protein, 249 aa, Artificial Sequence
  synthetic sequence
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 37 - protein, 125 aa, Artificial Sequence
  synthetic sequence
EVQLVESGGGLVQPGGSLRLSCAASGFTFNTYAMSWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 38 - protein, 109 aa, Artificial Sequence; identical to SEQ ID NO: 2
  synthetic sequence

SEQ ID NO: 39 - protein, 257 aa, Artificial Sequence
  synthetic sequence
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 40 - protein, 249 aa, Artificial Sequence
  synthetic sequence
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 41 - protein, 125 aa, Artificial Sequence
  synthetic sequence
EVQLVESGGGLVQPGGSLRLSCAASGFTFNTYAMNWVRQASGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 42 - protein, 109 aa, Artificial Sequence; identical to SEQ ID NO: 2
  synthetic sequence

SEQ ID NO: 43 - protein, 257 aa, Artificial Sequence
  synthetic sequence
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 44 - protein, 249 aa, Artificial Sequence
  synthetic sequence
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 45 - protein, 125 aa, Artificial Sequence
  synthetic sequence
EVQLVESGGGLVQPGGSLRLSCAASGFTFNTYAMNWVRQAPGKGLEWVGRIRSKANNYATYYADSVKGRFTISRDDSKNTLYLQMNSLRAEDTAVYYCVRHGNFGNSYVSWFAYWGQGTLVTVSS

SEQ ID NO: 46 - protein, 109 aa, Artificial Sequence; identical to SEQ ID NO: 2
  synthetic sequence

SEQ ID NO: 47 - protein, 257 aa, Artificial Sequence
  synthetic sequence
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 48 - protein, 249 aa, Artificial Sequence
  synthetic sequence
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 49 - protein, 125 aa, Artificial Sequence
  synthetic sequence
EVQLVESGGGLVQPGGSLRLSCAASGFTFNTYAMNWVRQAPGKGLEWVGRIRSKANSYATYYADSVKGRFTISRDDSKNTLYLQMNSLRAEDTAVYYCVRHGNFGNSYVSWFAYWGQGTLVTVSS

SEQ ID NO: 50 - protein, 109 aa, Artificial Sequence; identical to SEQ ID NO: 2
  synthetic sequence

SEQ ID NO: 51 - protein, 257 aa, Artificial Sequence
  synthetic sequence
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 52 - protein, 249 aa, Artificial Sequence
  synthetic sequence
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 53 - protein, 125 aa, Artificial Sequence
  synthetic sequence
EVQLVESGGGLVQPGGSLRLSCAASGFTFNTYAMNWVRQAPGKGLEWVGRIRSKYNNYATAYADSVKGRFTISRDDSKNTLYLQMNSLRAEDTAVYYCVRHGNFGNSYVSWFAYWGQGTLVTVSS

SEQ ID NO: 54 - protein, 109 aa, Artificial Sequence; identical to SEQ ID NO: 2
  synthetic sequence

SEQ ID NO: 55 - protein, 257 aa, Artificial Sequence
  synthetic sequence
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 56 - protein, 249 aa, Artificial Sequence
  synthetic sequence
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 57 - protein, 125 aa, Artificial Sequence
  synthetic sequence
EVQLVESGGGLVQPGGSLRLSCAASGFTFNTYAMNWVRQAPGKGLEWVGRIRSKYNNYATYYAASVKGRFTISRDDSKNTLYLQMNSLRAEDTAVYYCVRHGNFGNSYVSWFAYWGQGTLVTVSS

SEQ ID NO: 58 - protein, 109 aa, Artificial Sequence; identical to SEQ ID NO: 2
  synthetic sequence

SEQ ID NO: 59 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 60 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 61 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDNSKNTLYLQMNSLRAEDTAVYYCVRHGNFGNSYVSWFAYWGQGTLVTVSS

SEQ ID NO: 62 - protein, 109 aa, Artificial Sequence; identical to SEQ ID NO: 2
  synthetic sequence

SEQ ID NO: 63 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 64 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 65 - protein, 123 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDTSKNTLYLQMNSLRAEDTAVYYCVRHGNFGNSYVSWFAYWGQGTLVTV

SEQ ID NO: 66 - protein, 109 aa, Artificial Sequence; identical to SEQ ID NO: 2
  synthetic sequence

SEQ ID NO: 67 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 68 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 69 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTAYLQMNSLRAEDTAVYYCVRHGNFGNSYVSWFAYWGQGTLVTVSS

SEQ ID NO: 70 - protein, 109 aa, Artificial Sequence; identical to SEQ ID NO: 2
  synthetic sequence

SEQ ID NO: 71 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 72 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 73 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRDEDTAVYYCVRHGNFGNSYVSWFAYWGQGTLVTVSS

SEQ ID NO: 74 - protein, 109 aa, Artificial Sequence; identical to SEQ ID NO: 2
  synthetic sequence

SEQ ID NO: 75 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 76 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 77 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRKEDTAVYYCVRHGNFGNSYVSWFAYWGQGTLVTVSS

SEQ ID NO: 78 - protein, 109 aa, Artificial Sequence; identical to SEQ ID NO: 2
  synthetic sequence

SEQ ID NO: 79 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 80 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 81 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRSEDTAVYYCVRHGNFGNSYVSWFAYWGQGTLVTVSS

SEQ ID NO: 82 - protein, 109 aa, Artificial Sequence; identical to SEQ ID NO: 2
  synthetic sequence

SEQ ID NO: 83 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 84 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 85 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCARHGNFGNSYVSWFAYWGQGTLVTVSS

SEQ ID NO: 86 - protein, 109 aa, Artificial Sequence; identical to SEQ ID NO: 2
  synthetic sequence

SEQ ID NO: 87 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 88 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 89 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCTRHGNFGNSYVSWFAYWGQGTLVTVSS

SEQ ID NO: 90 - protein, 109 aa, Artificial Sequence; identical to SEQ ID NO: 2
  synthetic sequence

SEQ ID NO: 91 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 92 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 93 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 94 - protein, 109 aa, Artificial Sequence; identical to SEQ ID NO: 2
  synthetic sequence

SEQ ID NO: 95 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 96 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 97 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 98 - protein, 109 aa, Artificial Sequence; identical to SEQ ID NO: 2
  synthetic sequence

SEQ ID NO: 99 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 100 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 101 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNTYVSWFAYWGQGTLVTVSS

SEQ ID NO: 102 - protein, 109 aa, Artificial Sequence; identical to SEQ ID NO: 2
  synthetic sequence

SEQ ID NO: 103 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 104 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 105 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFDYWGQGTLVTVSS

SEQ ID NO: 106 - protein, 109 aa, Artificial Sequence; identical to SEQ ID NO: 2
  synthetic sequence

SEQ ID NO: 107 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 108 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 109 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTTVTVSS

SEQ ID NO: 110 - protein, 109 aa, Artificial Sequence; identical to SEQ ID NO: 2
  synthetic sequence

SEQ ID NO: 111 - protein, 257 aa, Artificial Sequence
  synthetic sequence
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 112 - protein, 249 aa, Artificial Sequence
  synthetic sequence
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 113 - protein, 125 aa, Artificial Sequence
  synthetic sequence
EVQLVESGGGLVQPGGSLRLSCAASGFTFNTYAMNWVRQAPGKSLEWVGRIRSKYNNYATYYADSVKGRFTISRDDSKNTLYLQMNSLRAEDTAVYYCVRHGNFGNSYVSWFAYWGQGTLVTVSS

SEQ ID NO: 114 - protein, 109 aa, Artificial Sequence; identical to SEQ ID NO: 2
  synthetic sequence

SEQ ID NO: 115 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 116 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 117 - protein, 125 aa, Artificial Sequence; identical to SEQ ID NO: 1
  synthetic sequence

SEQ ID NO: 118 - protein, 109 aa, Artificial Sequence
  synthetic sequence
QAVVTQPPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 119 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 120 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 121 - protein, 125 aa, Artificial Sequence; identical to SEQ ID NO: 1
  synthetic sequence

SEQ ID NO: 122 - protein, 109 aa, Artificial Sequence
  synthetic sequence
QAVVTQEPSLSVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 123 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 124 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 125 - protein, 125 aa, Artificial Sequence; identical to SEQ ID NO: 1
  synthetic sequence

SEQ ID NO: 126 - protein, 109 aa, Artificial Sequence
  synthetic sequence
QAVVTQEPSLTVSPGATVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 127 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 128 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 129 - protein, 125 aa, Artificial Sequence; identical to SEQ ID NO: 1
  synthetic sequence

SEQ ID NO: 130 - protein, 109 aa, Artificial Sequence
  synthetic sequence
QAVVTQEPSLTVSPGQTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 131 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 132 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 133 - protein, 125 aa, Artificial Sequence; identical to SEQ ID NO: 1
  synthetic sequence

SEQ ID NO: 134 - protein, 109 aa, Artificial Sequence
  synthetic sequence
QAVVTQEPSLTVSPGGTVTLTCGSSTGAVTSSNYANWVQQKPGQAPRGLIGGTNKRAPGVPARFSGSLLGGKAALTLSGAQPEDEAEYYCALWYSNLWVFGGGTKLTVL

SEQ ID NO: 135 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 136 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 137 - protein, 125 aa, Artificial Sequence; identical to SEQ ID NO: 1
  synthetic sequence

SEQ ID NO: 138 - protein, 109 aa, Artificial Sequence
  synthetic sequence
QAVVTQEPSLTVSPGGTVTLTCGSSTGAVTSGHYANWVQQKPGQAPRGLIGGTNKRAPGVPARFSGSLLGGKAALTLSGAQPEDEAEYYCALWYSNLWVFGGGTKLTVL

SEQ ID NO: 139 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVLGSHHHHHH

SEQ ID NO: 140 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 141 - protein, 125 aa, Artificial Sequence; identical to SEQ ID NO: 1
  synthetic sequence

SEQ ID NO: 142 - protein, 109 aa, Artificial Sequence
  synthetic sequence
QAVVTQEPSLTVSPGGTVTLTCGSSTGAVTTSNYANWVQQKPGQAPRGLIYDTNKRAPGVPARFSGSLLGGKAALTLSGAQPEDEAEYYCALWYSNLWVFGGGTKLTVL

SEQ ID NO: 143 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVLGSHHHHHH

SEQ ID NO: 144 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 145 - protein, 125 aa, Artificial Sequence; identical to SEQ ID NO: 1
  synthetic sequence

SEQ ID NO: 146 - protein, 109 aa, Artificial Sequence
  synthetic sequence
QAVVTQEPSLTVSPGGTVTLTCGSSTGAVTTSNYANWVQQKPGQAPRGLIGGTNNRAPGVPARFSGSLLGGKAALTLSGAQPEDEAEYYCALWYSNLWVFGGGTKLTVL

SEQ ID NO: 147 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVLGSHHHHHH

SEQ ID NO: 148 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 149 - protein, 125 aa, Artificial Sequence; identical to SEQ ID NO: 1
  synthetic sequence

SEQ ID NO: 150 - protein, 109 aa, Artificial Sequence
  synthetic sequence
QAVVTQEPSLTVSPGGTVTLTCGSSTGAVTTSNYANWVQQKPGQAPRGLIGGTNKRASGVPARFSGSLLGGKAALTLSGAQPEDEAEYYCALWYSNLWVFGGGTKLTVL

SEQ ID NO: 151 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVLGSHHHHHH

SEQ ID NO: 152 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 153 - protein, 125 aa, Artificial Sequence; identical to SEQ ID NO: 1
  synthetic sequence

SEQ ID NO: 154 - protein, 109 aa, Artificial Sequence
  synthetic sequence
QAVVTQEPSLTVSPGGTVTLTCGSSTGAVTTSNYANWVQQKPGQAPRGLIGGTSNKHSWTPARFSGSLLGGKAALTLSGAQPEDEAEYYCALWYSNLWVFGGGTKLTVL

SEQ ID NO: 155 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVLGSHHHHHH

SEQ ID NO: 156 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 157 - protein, 125 aa, Artificial Sequence; identical to SEQ ID NO: 1
  synthetic sequence

SEQ ID NO: 158 - protein, 109 aa, Artificial Sequence
  synthetic sequence
QAVVTQEPSLTVSPGGTVTLTCGSSTGAVTTSNYANWVQQKPGQAPRGLIGGTNKRAPGVPDRFSGSLLGGKAALTLSGAQPEDEAEYYCALWYSNLWVFGGGTKLTVL

SEQ ID NO: 159 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVLGSHHHHHH

SEQ ID NO: 160 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 161 - protein, 125 aa, Artificial Sequence; identical to SEQ ID NO: 1
  synthetic sequence

SEQ ID NO: 162 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSKSGGKAALTLSGAQPEDEAEYYCALWYSNLWVFGGGTKLTVL

SEQ ID NO: 163 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVLGSHHHHHH

SEQ ID NO: 164 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 165 - protein, 125 aa, Artificial Sequence; identical to SEQ ID NO: 1
  synthetic sequence

SEQ ID NO: 166 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSSSGGKAALTLSGAQPEDEAEYYCALWYSNLWVFGGGTKLTVL

SEQ ID NO: 167 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVLGSHHHHHH

SEQ ID NO: 168 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 169 - protein, 125 aa, Artificial Sequence; identical to SEQ ID NO: 1
  synthetic sequence

SEQ ID NO: 170 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNLWVFGGGTKLTVL

SEQ ID NO: 171 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVLGSHHHHHH

SEQ ID NO: 172 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 173 - protein, 125 aa, Artificial Sequence; identical to SEQ ID NO: 1
  synthetic sequence

SEQ ID NO: 174 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQAEDEAEYYCALWYSNLWVFGGGTKLTVL

SEQ ID NO: 175 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVLGSHHHHHH

SEQ ID NO: 176 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 177 - protein, 125 aa, Artificial Sequence; identical to SEQ ID NO: 1
  synthetic sequence

SEQ ID NO: 178 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQSEDEAEYYCALWYSNLWVFGGGTKLTVL

SEQ ID NO: 179 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVLGSHHHHHH

SEQ ID NO: 180 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 181 - protein, 125 aa, Artificial Sequence; identical to SEQ ID NO: 1
  synthetic sequence

SEQ ID NO: 182 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQPEDEADYYCALWYSNLWVFGGGTKLTVL

SEQ ID NO: 183 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVLGSHHHHHH

SEQ ID NO: 184 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 185 - protein, 125 aa, Artificial Sequence; identical to SEQ ID NO: 1
  synthetic sequence

SEQ ID NO: 186 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQPEDEAEYYCLLWYSNLWVFGGGTKLTVL

SEQ ID NO: 187 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVLGSHHHHHH

SEQ ID NO: 188 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 189 - protein, 125 aa, Artificial Sequence; identical to SEQ ID NO: 1
  synthetic sequence

SEQ ID NO: 190 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNHWVFGGGTKLTVL

SEQ ID NO: 191 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGSHHHHHH

SEQ ID NO: 192 - protein, 251 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 193 - protein, 125 aa, Artificial Sequence; identical to SEQ ID NO: 1
  synthetic sequence

SEQ ID NO: 194 - protein, 111 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLEIKGS

SEQ ID NO: 195 - protein, 258 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGSHHHHHH

SEQ ID NO: 196 - protein, 252 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSEIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 197 - protein, 125 aa, Artificial Sequence; identical to SEQ ID NO: 1
  synthetic sequence

SEQ ID NO: 198 - protein, 112 aa, Artificial Sequence
  synthetic sequence
EIVMTQSPATLSLSPGERATLSCRSSTGAVTTSNYANWVQQKPGQAPRGLIGGTNKRAPGVPARFSGSGSGTDFTLTISSLQPEDFAVYYCALWYSNLWVFGGGTKVEIKGS

SEQ ID NO: 199 - protein, 258 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGSHHHHHH

SEQ ID NO: 200 - protein, 252 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSDIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 201 - protein, 125 aa, Artificial Sequence; identical to SEQ ID NO: 1
  synthetic sequence

SEQ ID NO: 202 - protein, 112 aa, Artificial Sequence
  synthetic sequence
DIVMTQSPDSLAVSLGERATINCKSSTGAVTTSNYANWVQQKPGQPPKGLIGGTNKRAPGVPDRFSGSGSGTDFTLTISSLQAEDVAVYYCALWYSNLWVFGGGTKVEIKGS

SEQ ID NO: 203 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVLGSHHHHHH

SEQ ID NO: 204 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 205 - protein, 125 aa, Artificial Sequence; identical to SEQ ID NO: 1
  synthetic sequence

SEQ ID NO: 206 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTDSGAQPEDEADYYCALWYSNHWVFGGGTKLTVL

SEQ ID NO: 207 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 208 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 209 - protein, 125 aa, Artificial Sequence; identical to SEQ ID NO: 1
  synthetic sequence

SEQ ID NO: 210 - protein, 109 aa, Artificial Sequence
  synthetic sequence
QAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 211 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 212 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 213 - protein, 125 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTATYYCVRHGNFGNSYVSWFAYWGQGTLVTVSS

SEQ ID NO: 214 - protein, 109 aa, Artificial Sequence; identical to SEQ ID NO: 2
  synthetic sequence

SEQ ID NO: 215 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVLGSHHHHHH

SEQ ID NO: 216 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLTVL

SEQ ID NO: 217 - protein, 125 aa, Artificial Sequence; identical to SEQ ID NO: 1
  synthetic sequence

SEQ ID NO: 218 - protein, 107 aa, Artificial Sequence
  synthetic sequence
QAVVTQEPSLTVSPGGTVTLTCGSSTGAVTTSNYANWVQQKPGKAPRGLIGGTNKRAPGVPARFSGSLLGGKAALTLSGAQPEDEAEYYCALWYSNLWVFGGGTKLT

SEQ ID NO: 219 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVLGSHHHHHH

SEQ ID NO: 220 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 221 - protein, 125 aa, Artificial Sequence; identical to SEQ ID NO: 1
  synthetic sequence

SEQ ID NO: 222 - protein, 109 aa, Artificial Sequence
  synthetic sequence
QAVVTQEPSLTVSPGGTVTLTCGSSTGAVTTSNYANWVQQKPGTAPRGLIGGTNKRAPGVPARFSGSLLGGKAALTLSGAQPEDEAEYYCALWYSNLWVFGGGTKLTVL

SEQ ID NO: 223 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVLGSHHHHHH

SEQ ID NO: 224 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 225 - protein, 125 aa, Artificial Sequence; identical to SEQ ID NO: 1
  synthetic sequence

SEQ ID NO: 226 - protein, 109 aa, Artificial Sequence
  synthetic sequence
QAVVTQEPSLTVSPGGTVTLTCGSSTGAVTTSNYANWVQQKPGSPPRGLIGGTNKRAPGVPARFSGSLLGGKAALTLSGAQPEDEAEYYCALWYSNLWVFGGGTKLTVL

SEQ ID NO: 227 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVLGSHHHHHH

SEQ ID NO: 228 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 229 - protein, 125 aa, Artificial Sequence; identical to SEQ ID NO: 1
  synthetic sequence

SEQ ID NO: 230 - protein, 109 aa, Artificial Sequence
  synthetic sequence
QAVVTQEPSLTVSPGGTVTLTCGSSTGAVTTSNYANWVQQKPGQPPRGLIGGTNKRAPGVPARFSGSLLGGKAALTLSGAQPEDEAEYYCALWYSNLWVFGGGTKLTVL

SEQ ID NO: 231 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVLGSHHHHHH

SEQ ID NO: 232 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 233 - protein, 125 aa, Artificial Sequence; identical to SEQ ID NO: 1
  synthetic sequence

SEQ ID NO: 234 - protein, 109 aa, Artificial Sequence
  synthetic sequence
QAVVTQEPSLTVSPGGTVTLTCGSSTGAVTTSNYANWVQQKPGQGPRGLIGGTNKRAPGVPARFSGSLLGGKAALTLSGAQPEDEAEYYCALWYSNLWVFGGGTKLTVL

SEQ ID NO: 235 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVLGSHHHHHH

SEQ ID NO: 236 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 237 - protein, 125 aa, Artificial Sequence; identical to SEQ ID NO: 1
  synthetic sequence

SEQ ID NO: 238 - protein, 109 aa, Artificial Sequence
  synthetic sequence
QAVVTQEPSLTVSPGGTVTLTCGSSTGAVTTSNYANWVQQKPGQSPRGLIGGTNKRAPGVPARFSGSLLGGKAALTLSGAQPEDEAEYYCALWYSNLWVFGGGTKLTVL

SEQ ID NO: 239 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVLGSHHHHHH

SEQ ID NO: 240 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 241 - protein, 125 aa, Artificial Sequence; identical to SEQ ID NO: 1
  synthetic sequence

SEQ ID NO: 242 - protein, 109 aa, Artificial Sequence
  synthetic sequence
QAVVTQEPSLTVSPGGTVTLTCGSSTGAVTTSNYANWVQQKPGQDPRGLIGGTNKRAPGVPARFSGSLLGGKAALTLSGAQPEDEAEYYCALWYSNLWVFGGGTKLTVL

SEQ ID NO: 243 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 244 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 245 - protein, 125 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 246 - protein, 109 aa, Artificial Sequence; identical to SEQ ID NO: 2
  synthetic sequence

SEQ ID NO: 247 - protein, 257 aa, Artificial Sequence
  synthetic sequence
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 248 - protein, 249 aa, Artificial Sequence
  synthetic sequence
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 249 - protein, 125 aa, Artificial Sequence
  synthetic sequence
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 250 - protein, 109 aa, Artificial Sequence; identical to SEQ ID NO: 2
  synthetic sequence

SEQ ID NO: 251 - protein, 257 aa, Artificial Sequence
  synthetic sequence
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 252 - protein, 249 aa, Artificial Sequence
  synthetic sequence
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 253 - protein, 125 aa, Artificial Sequence
  synthetic sequence
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 254 - protein, 109 aa, Artificial Sequence; identical to SEQ ID NO: 2
  synthetic sequence

SEQ ID NO: 255 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 256 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 257 - protein, 125 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 258 - protein, 109 aa, Artificial Sequence; identical to SEQ ID NO: 2
  synthetic sequence

SEQ ID NO: 259 - protein, 257 aa, Artificial Sequence
  synthetic sequence
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 260 - protein, 249 aa, Artificial Sequence
  synthetic sequence
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 261 - protein, 125 aa, Artificial Sequence
  synthetic sequence
EVQLVESGGGLVQPGGSLRLSCAASGFTFSTYAMSWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 262 - protein, 109 aa, Artificial Sequence; identical to SEQ ID NO: 2
  synthetic sequence

SEQ ID NO: 263 - protein, 257 aa, Artificial Sequence
  synthetic sequence
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 264 - protein, 249 aa, Artificial Sequence
  synthetic sequence
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 265 - protein, 125 aa, Artificial Sequence
  synthetic sequence
EVQLVESGGEVKKPGESLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 266 - protein, 109 aa, Artificial Sequence; identical to SEQ ID NO: 2
  synthetic sequence

SEQ ID NO: 267 - protein, 255 aa, Artificial Sequence
  synthetic sequence
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 268 - protein, 247 aa, Artificial Sequence
  synthetic sequence
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 269 - protein, 123 aa, Artificial Sequence
  synthetic sequence
EVQLVESGGGLVQPGGSLRLSCAASGFTFNTYAMNWVRQAPGKGLEWVGRIRSNGGSTYYADSVKGRFTISRDDSKNTLYLQMNSLRAEDTAVYYCVRHGNFGNSYVSWFAYWGQGTLVTVSS

SEQ ID NO: 270 - protein, 109 aa, Artificial Sequence; identical to SEQ ID NO: 2
  synthetic sequence

SEQ ID NO: 271 - protein, 257 aa, Artificial Sequence
  synthetic sequence
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 272 - protein, 249 aa, Artificial Sequence
  synthetic sequence
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 273 - protein, 125 aa, Artificial Sequence
  synthetic sequence
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 274 - protein, 109 aa, Artificial Sequence; identical to SEQ ID NO: 2
  synthetic sequence

SEQ ID NO: 275 - protein, 257 aa, Artificial Sequence
  synthetic sequence
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVLGSHHHHHH

SEQ ID NO: 276 - protein, 249 aa, Artificial Sequence
  synthetic sequence
EVQLVESGGGLVQPGGSLRLSCAASGFTFNTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQEKPGQAPRGLIGGTNKRAPGVPARFSGSLLGGKAALTLSGAQPEDEAEYYCALWYSNLWVFGGGTKLTVL

SEQ ID NO: 277 - protein, 125 aa, Artificial Sequence; identical to SEQ ID NO: 273
  synthetic sequence

SEQ ID NO: 278 - protein, 109 aa, Artificial Sequence; identical to SEQ ID NO: 210
  synthetic sequence

SEQ ID NO: 279 - protein, 257 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 280 - protein, 249 aa, Artificial Sequence
  synthetic sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 281 - protein, 125 aa, Artificial Sequence; identical to SEQ ID NO: 1
  synthetic sequence

SEQ ID NO: 282 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 283 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 284 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 285 - protein, 125 aa, Artificial Sequence; identical to SEQ ID NO: 245
  synthetic sequence

SEQ ID NO: 286 - protein, 109 aa, Artificial Sequence; identical to SEQ ID NO: 282
  synthetic sequence

SEQ ID NO: 287 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 288 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 289 - protein, 125 aa, Artificial Sequence; identical to SEQ ID NO: 29
  synthetic sequence

SEQ ID NO: 290 - protein, 109 aa, Artificial Sequence; identical to SEQ ID NO: 282
  synthetic sequence

SEQ ID NO: 291 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 292 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 293 - protein, 125 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 294 - protein, 109 aa, Artificial Sequence; identical to SEQ ID NO: 282
  synthetic sequence

SEQ ID NO: 295 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVLGSHHHHHH

SEQ ID NO: 296 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEADYYCALWYSNHWVFGGGTKLTVL

SEQ ID NO: 297 - protein, 125 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 298 - protein, 109 aa, Artificial Sequence; identical to SEQ ID NO: 282
  synthetic sequence

SEQ ID NO: 299 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 300 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 301 - protein, 125 aa, Artificial Sequence; identical to SEQ ID NO: 245
  synthetic sequence

SEQ ID NO: 302 - protein, 109 aa, Artificial Sequence
  synthetic sequence
QAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 303 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 304 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 305 - protein, 125 aa, Artificial Sequence; identical to SEQ ID NO: 29
  synthetic sequence

SEQ ID NO: 306 - protein, 109 aa, Artificial Sequence; identical to SEQ ID NO: 302
  synthetic sequence

SEQ ID NO: 307 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 308 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 309 - protein, 125 aa, Artificial Sequence; identical to SEQ ID NO: 293
  synthetic sequence

SEQ ID NO: 310 - protein, 109 aa, Artificial Sequence; identical to SEQ ID NO: 302
  synthetic sequence

SEQ ID NO: 311 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVLGSHHHHHH

SEQ ID NO: 312 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTISGAQPEDEAEYYCALWYSNHWVFGGGTKLTVL

SEQ ID NO: 313 - protein, 125 aa, Artificial Sequence; identical to SEQ ID NO: 297
  synthetic sequence

SEQ ID NO: 314 - protein, 109 aa, Artificial Sequence; identical to SEQ ID NO: 302
  synthetic sequence

SEQ ID NO: 315 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 316 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 317 - protein, 125 aa, Artificial Sequence; identical to SEQ ID NO: 245
  synthetic sequence

SEQ ID NO: 318 - protein, 109 aa, Artificial Sequence
  synthetic sequence
QAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 319 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 320 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 321 - protein, 125 aa, Artificial Sequence; identical to SEQ ID NO: 29
  synthetic sequence

SEQ ID NO: 322 - protein, 109 aa, Artificial Sequence; identical to SEQ ID NO: 318
  synthetic sequence

SEQ ID NO: 323 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 324 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 325 - protein, 125 aa, Artificial Sequence; identical to SEQ ID NO: 293
  synthetic sequence

SEQ ID NO: 326 - protein, 109 aa, Artificial Sequence; identical to SEQ ID NO: 318
  synthetic sequence

SEQ ID NO: 327 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVLGSHHHHHH

SEQ ID NO: 328 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEAEYYCALWYSNHWVFGGGTKLTVL

SEQ ID NO: 329 - protein, 125 aa, Artificial Sequence; identical to SEQ ID NO: 297
  synthetic sequence

SEQ ID NO: 330 - protein, 109 aa, Artificial Sequence; identical to SEQ ID NO: 318
  synthetic sequence

SEQ ID NO: 331 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 332 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 333 - protein, 125 aa, Artificial Sequence; identical to SEQ ID NO: 245
  synthetic sequence

SEQ ID NO: 334 - protein, 109 aa, Artificial Sequence
  synthetic sequence
QAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 335 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 336 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 337 - protein, 125 aa, Artificial Sequence; identical to SEQ ID NO: 29
  synthetic sequence

SEQ ID NO: 338 - protein, 109 aa, Artificial Sequence; identical to SEQ ID NO: 334
  synthetic sequence

SEQ ID NO: 339 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 340 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 341 - protein, 125 aa, Artificial Sequence; identical to SEQ ID NO: 293
  synthetic sequence

SEQ ID NO: 342 - protein, 109 aa, Artificial Sequence; identical to SEQ ID NO: 334
  synthetic sequence

SEQ ID NO: 343 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVLGSHHHHHH

SEQ ID NO: 344 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEAEYYCALWYSNHWVFGGGTKLTVL

SEQ ID NO: 345 - protein, 125 aa, Artificial Sequence; identical to SEQ ID NO: 297
  synthetic sequence

SEQ ID NO: 346 - protein, 109 aa, Artificial Sequence; identical to SEQ ID NO: 334
  synthetic sequence

SEQ ID NO: 347 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 348 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 349 - protein, 125 aa, Artificial Sequence; identical to SEQ ID NO: 245
  synthetic sequence

SEQ ID NO: 350 - protein, 109 aa, Artificial Sequence
  synthetic sequence
QAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 351 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 352 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 353 - protein, 125 aa, Artificial Sequence; identical to SEQ ID NO: 29
  synthetic sequence

SEQ ID NO: 354 - protein, 109 aa, Artificial Sequence; identical to SEQ ID NO: 350
  synthetic sequence

SEQ ID NO: 355 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 356 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 357 - protein, 125 aa, Artificial Sequence; identical to SEQ ID NO: 293
  synthetic sequence

SEQ ID NO: 358 - protein, 109 aa, Artificial Sequence; identical to SEQ ID NO: 350
  synthetic sequence

SEQ ID NO: 359 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVLGSHHHHHH

SEQ ID NO: 360 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEAEYYCALWYSNHWVFGGGTKLTVL

SEQ ID NO: 361 - protein, 125 aa, Artificial Sequence; identical to SEQ ID NO: 297
  synthetic sequence

SEQ ID NO: 362 - protein, 109 aa, Artificial Sequence; identical to SEQ ID NO: 350
  synthetic sequence

SEQ ID NO: 363 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 364 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 365 - protein, 125 aa, Artificial Sequence; identical to SEQ ID NO: 245
  synthetic sequence

SEQ ID NO: 366 - protein, 109 aa, Artificial Sequence
  synthetic sequence
QAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 367 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 368 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 369 - protein, 125 aa, Artificial Sequence; identical to SEQ ID NO: 29
  synthetic sequence

SEQ ID NO: 370 - protein, 109 aa, Artificial Sequence; identical to SEQ ID NO: 366
  synthetic sequence

SEQ ID NO: 371 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 372 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 373 - protein, 125 aa, Artificial Sequence; identical to SEQ ID NO: 293
  synthetic sequence

SEQ ID NO: 374 - protein, 109 aa, Artificial Sequence; identical to SEQ ID NO: 366
  synthetic sequence

SEQ ID NO: 375 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVLGSHHHHHH

SEQ ID NO: 376 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKAPRGLIGGTNKRAPGVPARFSGSLLGGKAALTISGAQPEDEADYYCALWYSNHWVFGGGTKLTVL

SEQ ID NO: 377 - protein, 125 aa, Artificial Sequence; identical to SEQ ID NO: 297
  synthetic sequence

SEQ ID NO: 378 - protein, 109 aa, Artificial Sequence; identical to SEQ ID NO: 366
  synthetic sequence

SEQ ID NO: 379 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 380 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 381 - protein, 125 aa, Artificial Sequence; identical to SEQ ID NO: 245
  synthetic sequence

SEQ ID NO: 382 - protein, 109 aa, Artificial Sequence
  synthetic sequence
QAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 383 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 384 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 385 - protein, 125 aa, Artificial Sequence; identical to SEQ ID NO: 29
  synthetic sequence

SEQ ID NO: 386 - protein, 109 aa, Artificial Sequence; identical to SEQ ID NO: 382
  synthetic sequence

SEQ ID NO: 387 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 388 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 389 - protein, 125 aa, Artificial Sequence; identical to SEQ ID NO: 293
  synthetic sequence

SEQ ID NO: 390 - protein, 109 aa, Artificial Sequence; identical to SEQ ID NO: 382
  synthetic sequence

SEQ ID NO: 391 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVLGSHHHHHH

SEQ ID NO: 392 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGQSPRGLIGGTNKRAPGVPARFSGSLLGGKAALTISGAQPEDEADYYCALWYSNHWVFGGGTKLTVL

SEQ ID NO: 393 - protein, 125 aa, Artificial Sequence; identical to SEQ ID NO: 297
  synthetic sequence

SEQ ID NO: 394 - protein, 109 aa, Artificial Sequence; identical to SEQ ID NO: 382
  synthetic sequence

SEQ ID NO: 395 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 396 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 397 - protein, 125 aa, Artificial Sequence; identical to SEQ ID NO: 245
  synthetic sequence

SEQ ID NO: 398 - protein, 109 aa, Artificial Sequence
  synthetic sequence
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 399 - protein, 257 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 400 - protein, 249 aa, Artificial Sequence
  synthetic sequence
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 401 - protein, 125 aa, Artificial Sequence; identical to SEQ ID NO: 29
  synthetic sequence

SEQ ID NO: 402 - protein, 109 aa, Artificial Sequence; identical to SEQ ID NO: 398
  synthetic sequence

SEQ ID NO: 403 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 404 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 405 - protein, 125 aa, Artificial Sequence; identical to SEQ ID NO: 293
  synthetic sequence

SEQ ID NO: 406 - protein, 109 aa, Artificial Sequence; identical to SEQ ID NO: 398
  synthetic sequence

SEQ ID NO: 407 - protein, 257 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 408 - protein, 249 aa, Artificial Sequence
  synthetic sequence
EVQLVESGGGLVQPGGSLRLSCAASGFTFSTYAMNWVRKAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 409 - protein, 125 aa, Artificial Sequence; identical to SEQ ID NO: 297
  synthetic sequence

SEQ ID NO: 410 - protein, 109 aa, Artificial Sequence; identical to SEQ ID NO: 398
  synthetic sequence

SEQ ID NO: 411 - protein, 5 aa, Artificial Sequence
  variable heavy chain sequence CDR1
TYAMN

SEQ ID NO: 412 - protein, 5 aa, Artificial Sequence
  variable heavy chain sequence CDR1
TYAMS

SEQ ID NO: 413 - protein, 19 aa, Artificial Sequence
  variable heavy chain sequence CDR2
RIRSKYNNYATYYADSVKG

SEQ ID NO: 414 - protein, 19 aa, Artificial Sequence
  variable heavy chain sequence CDR2
RIRSKANNYATYYADSVKG

SEQ ID NO: 415 - protein, 17 aa, Artificial Sequence
  variable heavy chain sequence CDR2
RIRSNGGSTYYADSVKG

SEQ ID NO: 416 - protein, 14 aa, Artificial Sequence
  variable heavy chain sequence CDR3
HGNFGNSYVSWFAY

SEQ ID NO: 417 - protein, 14 aa, Artificial Sequence
  variable heavy chain sequence CDR3
HGNFGDSYVSWFAY

SEQ ID NO: 418 - protein, 14 aa, Artificial Sequence
  variable heavy chain sequence CDR3
HGNFGQSYVSWFAY

SEQ ID NO: 419 - protein, 14 aa, Artificial Sequence
  variable heavy chain sequence CDR3
HGNFGDSYVSWFDY

SEQ ID NO: 420 - protein, 14 aa, Artificial Sequence
  variable light chain sequence CDR1
GSSTGAVTTSNYAN

SEQ ID NO: 421 - protein, 14 aa, Artificial Sequence
  variable light chain sequence CDR1
GSSTGAVTSSNYAN

SEQ ID NO: 422 - protein, 14 aa, Artificial Sequence
  variable light chain sequence CDR1
GSSTGAVTSGHYAN

SEQ ID NO: 423 - protein, 14 aa, Artificial Sequence
  variable light chain sequence CDR1
RSSTGAVTTSNYAN

SEQ ID NO: 424 - protein, 14 aa, Artificial Sequence
  variable light chain sequence CDR1
KSSTGAVTTSNYAN

SEQ ID NO: 425 - protein, 7 aa, Artificial Sequence
  variable light chain sequence CDR2
GTNKRAP

SEQ ID NO: 426 - protein, 7 aa, Artificial Sequence
  variable light chain sequence CDR2
DTNKRAP

SEQ ID NO: 427 - protein, 7 aa, Artificial Sequence
  variable light chain sequence CDR2
GTNNRAP

SEQ ID NO: 428 - protein, 7 aa, Artificial Sequence
  variable light chain sequence CDR2
GTNKRAS

SEQ ID NO: 429 - protein, 19 aa, Artificial Sequence
  variable heavy chain sequence CDR2
RIRSKYNNYATAYADSVKG

SEQ ID NO: 430 - protein, 9 aa, Artificial Sequence
  variable light chain sequence CDR3
ALWYSNLWV

SEQ ID NO: 431 - protein, 19 aa, Artificial Sequence
  variable heavy chain sequence CDR2
RIRSKYNNYATYYAASVKG

SEQ ID NO: 432 - protein, 5 aa, Artificial Sequence
  variable heavy chain sequence CDR1
TYAMH

SEQ ID NO: 433 - protein, 9 aa, Artificial Sequence
  variable light chain sequence CDR3
ALWYSNHWV

SEQ ID NO: 434 - protein, 19 aa, Artificial Sequence
  variable heavy chain sequence CDR2
RIRSKANSYATYYADSVKG

SEQ ID NO: 435 - protein, 5 aa, Artificial Sequence
  variable heavy chain sequence CDR1
  MISC_FEATURE (5)..(5): Xaa can be Asn, Ser or His
TYAMX

SEQ ID NO: 436 - protein, 20 aa, Artificial Sequence
  variable heavy chain sequence CDR2
  MISC_FEATURE (6)..(6): Xaa can be Tyr or Ala
  MISC_FEATURE (8)..(8): Xaa can be Asn or Ser
  MISC_FEATURE (12)..(12): Xaa can be Tyr or Ala
  MISC_FEATURE (16)..(16): Xaa can be Asp or Ala
RIRSKXNXYATXYYAXSVKG

SEQ ID NO: 437 - protein, 14 aa, Artificial Sequence
  variable heavy chain sequence CDR3
  MISC_FEATURE (6)..(6): Xaa can be Asn, Asp or Gln
  MISC_FEATURE (13)..(13): Xaa can be Ala or Asp
HGNFGXSYVSWFXY

SEQ ID NO: 438 - protein, 14 aa, Artificial Sequence
  variable light chain sequence CDR1
  MISC_FEATURE (1)..(1): Xaa can be Gly, Arg or Lys
  MISC_FEATURE (9)..(9): Xaa can be Thr or Ser
  MISC_FEATURE (10)..(10): Xaa can be Ser or Gly
  MISC_FEATURE (11)..(11): Xaa can be Asn or His
XSSTGAVTXXXYAN

SEQ ID NO: 439 - protein, 7 aa, Artificial Sequence
  variable light chain sequence CDR2
  MISC_FEATURE (1)..(1): Xaa can be Gly or Asp
  MISC_FEATURE (4)..(4): Xaa can be Lys or Asn
  MISC_FEATURE (7)..(7): Xaa can be Pro or Ser
XTNXRAX

SEQ ID NO: 440 - protein, 9 aa, Artificial Sequence
  variable light chain sequence CDR3
  MISC_FEATURE (1)..(1): Xaa can be Ala or Leu
  MISC_FEATURE (7)..(7): Xaa can be Leu or His
XLWYSNXWV

SEQ ID NO: 441 - protein, 451 aa, Artificial Sequence
  heavy chain sequence-Fab
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 481 aa, Artificial Sequence
  heavy chain sequence-scFv
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 219 aa, Artificial Sequence
  light chain sequence
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 444 - protein, 450 aa, Artificial Sequence
  heavy-chain sequence-Fab
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 445 - protein, 481 aa, Artificial Sequence; identical to SEQ ID NO: 442
  heavy chain sequence-scFv

SEQ ID NO: 446 - protein, 219 aa, Artificial Sequence; identical to SEQ ID NO: 443
  light chain sequence

SEQ ID NO: 447 - protein, 125 aa, Artificial Sequence; identical to SEQ ID NO: 1
  Humanized Anti-CD3 variable heavy chain sequence with Kabat CDRs underlined

SEQ ID NO: 448 - protein, 109 aa, Artificial Sequence; identical to SEQ ID NO: 2
  Humanized Anti-CD3 variable light chain sequence with Kabat CDRs underlined

SEQ ID NO: 449 - protein, 445 aa, Artificial Sequence
  heavy chain sequence-Fab
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLTVDKSRWQEGNVFSCSVMHEALHNHYTQKSLSLSPG

SEQ ID NO: 450 - protein, 481 aa, Artificial Sequence; identical to SEQ ID NO: 442
  heavy chain sequence-scFv

SEQ ID NO: 451 - protein, 214 aa, Artificial Sequence
  light chain sequence
DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - protein, 450 aa, Artificial Sequence; identical to SEQ ID NO: 444
  Heavy Chain HC-Fab

SEQ ID NO: 453 - protein, 481 aa, Artificial Sequence; identical to SEQ ID NO: 442
  Heavy Chain HC-scFv

SEQ ID NO: 454 - protein, 450 aa, Artificial Sequence
  Heavy Chain HC-Fab (T411E)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCLVKGFYPSDIAVEWESSGQPENNYNTTPPMLDSDGSFFLYSKLEVDKSRWQEGNVFSCSVMHEALHNHYTQKSLSLSPG

SEQ ID NO: 455 - protein, 481 aa, Artificial Sequence
  Heavy Chain HC-scFv (D401K)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 456 - protein, 450 aa, Artificial Sequence
  Heavy Chain HC-Fab (L368E)
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPELLRGPSVFLFPPKPKDTLMISRTPEVTCVVVDVSHEDPEVQFNWYVDGVEVHNAKTKPREEQYNSTYRVVSVLTVLHQDWLNGKEYKCKVSNKARPAPIEKTISKAKGQPREPQVYTLPPSQEEMTKNQVSLTCEVKGFYPSDIAVEWESSGQPENNYNTTPPMLDSDGSFFLYSKLTVDKSRWQEGNVFSCSVMHEALHNHYTQKSLSLSPG

SEQ ID NO: 457 - protein, 481 aa, Artificial Sequence
  Heavy Chain HC-scFv (S364K)
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLERKSSDKTHTCPRCPAPELLRGPSVFLFPPKPKDTLMISRTPEVTCVVVDVSHEDPEVKFKWYVDGVEVHNAKTKPREEQYNSTYRVVSVLTVLHQDWLNGKEYKCKVSNKARPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 219 aa, Artificial Sequence; identical to SEQ ID NO: 443
  light chain sequence

SEQ ID NO: 459 - protein, 207 aa, Artificial Sequence
  Human T-cell surface glycoprotein CD3 epsilon chain
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 460 - protein, 4 aa, Artificial Sequence
  sequence linker
GFLG

SEQ ID NO: 461 - protein, 14 aa, Artificial Sequence
  variable heavy chain CDR3
HGNFGNSYVSWFDY

SEQ ID NO: 462 - protein, 7 aa, Artificial Sequence
  variable light chain CDR2
GTSNKHS

SEQ ID NO: 463 - protein, 15 aa, Artificial Sequence
  Positive charged scFv linkers Gly-Ser 15
GGGGSGGGGSGGGGS

SEQ ID NO: 464 - protein, 18 aa, Artificial Sequence
  Positive charged scFv linkers Whitlow linker
GSTSGSGKPGSGEGSTKG

SEQ ID NO: 465 - protein, 14 aa, Artificial Sequence
  Positive charged scFv linkers 6paxA_1 (+A)
IRPRAIGGSKPRVA

SEQ ID NO: 466 - protein, 15 aa, Artificial Sequence
  Positive charged scFv linkers +B
GKGGSGKGGSGKGGS

SEQ ID NO: 467 - protein, 15 aa, Artificial Sequence
  Positive charged scFv linkers +C
GGKGSGGKGSGGKGS

SEQ ID NO: 468 - protein, 15 aa, Artificial Sequence
  Positive charged scFv linkers +D
GGGKSGGGKSGGGKS

SEQ ID NO: 469 - protein, 15 aa, Artificial Sequence
  Positive charged scFv linkers +E
GKGKSGKGKSGKGKS

SEQ ID NO: 470 - protein, 15 aa, Artificial Sequence
  Positive charged scFv linkers +F
GGGKSGGKGSGKGGS

SEQ ID NO: 471 - protein, 15 aa, Artificial Sequence
  Positive charged scFv linkers +G
GKPGSGKPGSGKPGS

SEQ ID NO: 472 - protein, 20 aa, Artificial Sequence
  Positive charged scFv linkers +H
GKPGSGKPGSGKPGSGKPGS

SEQ ID NO: 473 - protein, 20 aa, Artificial Sequence
  Positive charged scFv linkers +I
GKGKSGKGKSGKGKSGKGKS

SEQ ID NO: 474 - protein, 20 aa, Artificial Sequence
  Negative charged scFv linkers Gly-Ser 15
GGGGSGGGGSGGGGSGGGGS

SEQ ID NO: 475 - protein, 14 aa, Artificial Sequence
  Negative charged scFv linkers 3hsc_2 (-A)
STAGDTHLGGEDFD

SEQ ID NO: 476 - protein, 15 aa, Artificial Sequence
  Negative charged scFv linkers -B
GEGGSGEGGSGEGGS

SEQ ID NO: 477 - protein, 15 aa, Artificial Sequence
  Negative charged scFv linkers -C
GGEGSGGEGSGGEGS

SEQ ID NO: 478 - protein, 15 aa, Artificial Sequence
  Negative charged scFv linkers -D
GGGESGGGESGGGES

SEQ ID NO: 479 - protein, 15 aa, Artificial Sequence
  Negative charged scFv linkers -E
GEGESGEGESGEGES

SEQ ID NO: 480 - protein, 15 aa, Artificial Sequence
  Negative charged scFv linkers -F
GGGESGGEGSGEGGS

SEQ ID NO: 481 - protein, 20 aa, Artificial Sequence
  Negative charged scFv linkers -G
GEGESGEGESGEGESGEGES

We claim:

1. A heterodimeric antibody comprising:
    a) a first heavy chain comprising:
        i) a first Fc domain; and
        ii) a single chain FIT region (scFv) that binds CD3 comprising a first variable heavy chain, a variable light chain and a charged scFv linker, wherein said charged scFv linker covalently attaches said first variable heavy chain and said variable light chain;
    b) a second heavy chain comprising a VH-CH1-hinge-CH2-CH3 monomer, wherein VH is a second variable heavy chain and CH2-CH3 is a second Fc domain; and
    c) a light chain,
    wherein said first variable heavy chain comprises a vhCDR1 having the amino acid sequence of SEQ ID NO:411; a vhCDR2 having the amino acid sequence of SEQ ID NO: 413; and a vhCDR3 having the amino acid sequence of SEQ ID NO: 417, and
    wherein said variable light chain comprises a vlCDR1 having the amino acid sequence of SEQ ID NO: 420; a vlCDR2 having the amino acid sequence of SEQ ID NO: 425; and a vlCDR3 having the amino acid sequence of SEQ ID NO: 433.

2. The heterodimeric antibody according to claim 1, wherein said first variable heavy chain has the amino acid sequence of SEQ ID NO: 397 and said variable light chain has the amino acid sequence of SEQ ID NO: 398.

3. The heterodimeric antibody according to claim 1, wherein said charged scFv linker is a positive charged linker.

4. The heterodimeric antibody according to claim 2, wherein said charged scFv linker is a positive charged linker.

5. The heterodimeric antibody according to claim 1, wherein said charged scFv linker is a negatively charged linker.

6. The heterodimeric antibody according to claim 2, wherein said charged scFv linker is a negatively charged linker.

7. The heterodimeric antibody of claim 1, wherein said first and second Fc domains are variant Fc domains as compared to a parent Fc polypeptide.

8. The heterodimeric antibody of claim 7, wherein said parent Fc polypeptide is selected from the group consisting of a human IgG1, IgG2 and IgG4 Fc polypeptide.

9. The heterodimeric antibody of claim 2, wherein said first and second Fc domains are variant Fc domains as compared to a parent Fc polypeptide.

10. The heterodimeric antibody of claim 9, wherein said parent Fc polypeptide is selected from the group consisting of a human IgG1, IgG2 and IgG4 Fc polypeptide.

11. The heterodimeric antibody of claim 1, wherein said charged scFv linker comprises SEQ ID NO: 472.

12. The heterodimeric antibody of claim 2, wherein said charged scFv linker comprises SEQ ID NO: 472.

13. A heterodimeric antibody comprising:
    a) a first heavy chain comprising:
        i) a first variant Fc domain; and
        ii) a single chain Fv region (scFv) that binds CD3 comprising a first variable heavy chain comprising SEQ ID NO: 397, a variable light chain comprising SEQ ID NO: 398 and a charged scFv linker comprising SEQ ID NO: 472, wherein said charged scFv linker covalently attaches said first variable heavy chain and said variable light chain;

b) a second heavy chain comprising a VH-CH1-hinge-CH2-CH3 monomer, wherein VH is a second variable heavy chain and CH2-CH3 is a second variant Fc domain; and c) a light chain.

14. The heterodimeric antibody of claim 13, wherein said first and second Fc domains are variant Fc domains as compared to a parent Fc polypeptide.

15. The heterodimeric antibody of claim 14, wherein said parent Fc polypeptide is selected from the group consisting of a human IgG1, IgG2 and IgG4 Fc polypeptide.

* * * * *